US008921658B2

(12) United States Patent
Emmanuel et al.

(10) Patent No.: US 8,921,658 B2
(45) Date of Patent: Dec. 30, 2014

(54) ISOLATED POLYNUCLEOTIDES ENCODING A MAP65 POLYPEPTIDE AND METHODS OF USING SAME FOR INCREASING PLANT YIELD

(75) Inventors: Eyal Emmanuel, Rechovot (IL); Zur Granevitze, Petach-Tikva (IL); Alex Diber, Rishon-LeZion (IL); Basia Judith Vinocur, Rechovot (IL); Sharon Ayal, Kiryat-Ekron (IL); Yoav Herschkovitz, Givataim (IL)

(73) Assignee: Evogene Ltd., Rechovot (IL)

( * ) Notice: Subject to any disclaimer, the term of this patent is extended or adjusted under 35 U.S.C. 154(b) by 233 days.

(21) Appl. No.: 13/125,047

(22) PCT Filed: Oct. 28, 2009

(86) PCT No.: PCT/IB2009/054774
§ 371 (c)(1),
(2), (4) Date: Apr. 20, 2011

(87) PCT Pub. No.: WO2010/049897
PCT Pub. Date: May 6, 2010

(65) Prior Publication Data
US 2011/0197315 A1  Aug. 11, 2011

Related U.S. Application Data

(60) Provisional application No. 61/193,141, filed on Oct. 30, 2008, provisional application No. 61/187,683, filed on Jun. 17, 2009.

(51) Int. Cl.
*C07K 14/415* (2006.01)
*C12N 15/29* (2006.01)
*C12N 15/82* (2006.01)

(52) U.S. Cl.
CPC ........ *C12N 15/8261* (2013.01); *C12N 15/8247* (2013.01); *C12N 15/8273* (2013.01)
USPC .......................................... 800/289; 800/278

(58) Field of Classification Search
None
See application file for complete search history.

(56) References Cited

U.S. PATENT DOCUMENTS

| | | | |
|---|---|---|---|
| 3,791,932 A | 2/1974 | Schuurs et al. |
| 3,839,153 A | 10/1974 | Schuurs et al. |
| 3,850,578 A | 11/1974 | McConnell |
| 3,850,752 A | 11/1974 | Schuurs et al. |
| 3,853,987 A | 12/1974 | Dreyer |
| 3,867,517 A | 2/1975 | Ling |
| 3,879,262 A | 4/1975 | Schuurs et al. |
| 3,901,654 A | 8/1975 | Gross |
| 3,935,074 A | 1/1976 | Rubenstein et al. |
| 3,984,533 A | 10/1976 | Uzgiris |
| 3,996,345 A | 12/1976 | Ullman et al. |
| 4,034,074 A | 7/1977 | Miles |
| 4,098,876 A | 7/1978 | Piasio et al. |
| 4,666,828 A | 5/1987 | Gusella |
| 4,683,202 A | 7/1987 | Mullis |
| 4,801,531 A | 1/1989 | Frossard |
| 4,879,219 A | 11/1989 | Wands et al. |
| 4,943,674 A | 7/1990 | Houck et al. |
| 4,945,050 A | 7/1990 | Sanford et al. |
| 5,011,771 A | 4/1991 | Bellet et al. |
| 5,187,267 A | 2/1993 | Comai et al. |
| 5,192,659 A | 3/1993 | Simons |
| 5,268,463 A | 12/1993 | Jefferson |
| 5,272,057 A | 12/1993 | Smulson et al. |
| 5,281,521 A | 1/1994 | Trojanowski et al. |
| 5,296,462 A | 3/1994 | Thomashow |
| 5,316,931 A | 5/1994 | Donson et al. |
| 5,356,816 A | 10/1994 | Thomashow |
| 5,399,680 A | 3/1995 | Zhu et al. |
| 5,464,765 A | 11/1995 | Coffee et al. |
| 5,466,785 A | 11/1995 | De Framond |
| 5,495,070 A | 2/1996 | John |
| 5,504,200 A | 4/1996 | Hall et al. |
| 5,521,708 A | 5/1996 | Beretta |
| 5,569,597 A | 10/1996 | Grimsley et al. |
| 5,597,718 A | 1/1997 | John et al. |
| 5,604,121 A | 2/1997 | Hilder et al. |
| 5,608,142 A | 3/1997 | Barton et al. |
| 5,608,144 A | 3/1997 | Baden et al. |
| 5,608,149 A | 3/1997 | Barry et al. |
| 5,608,152 A | 3/1997 | Kridl et al. |
| 5,620,882 A | 4/1997 | John |

(Continued)

FOREIGN PATENT DOCUMENTS

| | | |
|---|---|---|
| AU | 2005229157 | 10/2005 |
| AU | 2005234725 | 12/2005 |
| CN | 1823168 | 8/2006 |
| EP | 0834566 | 4/1998 |
| EP | 0905242 | 3/1999 |

(Continued)

OTHER PUBLICATIONS

Zhang et al. Phosphatidic acid regulates microtubule organization by interacting with MAP65-1 in repsonse to salt stress in *Arabidopsis*. The Plant Cell. 2012. 24(11): 4555-4576.*

(Continued)

*Primary Examiner* — Cathy Kingdon Worley
*Assistant Examiner* — Ashley K Buran

(57) ABSTRACT

Provided are methods of increasing yield, biomass, growth rate, vigor, and/or abiotic stress tolerance of a plant by expressing within the plant an exogenous polynucleotide comprising a nucleic acid sequence at least 80% identical to SEQ ID NO: 27 or 868; or an exogenous polynucleotide encoding a polypeptide at least 80% identical to SEQ ID NO: 132 (MAP65 from Arabidopsis).

13 Claims, 3 Drawing Sheets

(56) References Cited

U.S. PATENT DOCUMENTS

| | | |
|---|---|---|
| 5,659,026 A | 8/1997 | Baszczynski et al. |
| 5,693,507 A | 12/1997 | Daniell et al. |
| 5,859,330 A | 1/1999 | Bestwick et al. |
| 5,880,100 A | 3/1999 | Ogiso et al. |
| 5,981,834 A | 11/1999 | John et al. |
| 6,080,914 A | 6/2000 | Conner |
| 6,084,153 A | 7/2000 | Good et al. |
| 6,313,375 B1 | 11/2001 | Jung et al. |
| 6,313,376 B1 | 11/2001 | Jung et al. |
| 6,359,196 B1 | 3/2002 | Lok et al. |
| 6,392,122 B1 | 5/2002 | Clendennen et al. |
| 6,403,862 B1 | 6/2002 | Jiao et al. |
| 6,472,588 B1 | 10/2002 | Haigler et al. |
| 6,670,528 B1 | 12/2003 | Shinozaki et al. |
| 6,720,477 B2 | 4/2004 | Da Costa e Silva et al. |
| 7,214,786 B2 | 5/2007 | Kovalic et al. |
| 7,554,007 B2 | 6/2009 | Ronen et al. |
| 7,812,218 B2 | 10/2010 | Ronen et al. |
| 7,910,800 B2 | 3/2011 | Karchi et al. |
| 8,049,069 B2 | 11/2011 | Wu et al. |
| 8,168,857 B2 | 5/2012 | Ayal et al. |
| 8,426,682 B2 | 4/2013 | Ronen et al. |
| 2002/0046419 A1 | 4/2002 | Choo et al. |
| 2002/0049999 A1 | 4/2002 | Allen et al. |
| 2002/0148007 A1 | 10/2002 | Jiao et al. |
| 2002/0160378 A1 | 10/2002 | Harper et al. |
| 2002/0170088 A1 | 11/2002 | Wilkins |
| 2003/0005485 A1 | 1/2003 | Ohlrogge et al. |
| 2003/0074697 A1 | 4/2003 | Allen et al. |
| 2003/0084485 A1 | 5/2003 | Zhu et al. |
| 2003/0162294 A1 | 8/2003 | Verbruggen |
| 2003/0163839 A1 | 8/2003 | Helentjaris et al. |
| 2003/0233670 A1 | 12/2003 | Edgerton et al. |
| 2004/0006794 A1 | 1/2004 | Wilkins |
| 2004/0019927 A1 | 1/2004 | Sherman et al. |
| 2004/0031072 A1 | 2/2004 | La Rosa et al. |
| 2004/0034888 A1 | 2/2004 | Liu et al. |
| 2004/0123343 A1 | 6/2004 | La Rosa et al. |
| 2004/0172684 A1 | 9/2004 | Kovalic et al. |
| 2004/0181830 A1 | 9/2004 | Kovalic et al. |
| 2005/0108791 A1 | 5/2005 | Edgerton et al. |
| 2006/0048240 A1 | 3/2006 | Alexandrov et al. |
| 2006/0101543 A1 | 5/2006 | Somerville et al. |
| 2006/0107345 A1 | 5/2006 | Alexandrov et al. |
| 2006/0123505 A1 | 6/2006 | Kikuchi et al. |
| 2006/0123516 A1 | 6/2006 | Ronen et al. |
| 2006/0137043 A1 | 6/2006 | Puzio et al. |
| 2006/0143729 A1 | 6/2006 | Alexandrov et al. |
| 2006/0150283 A1 | 7/2006 | Alexandrov et al. |
| 2006/0168684 A1 | 7/2006 | Renz et al. |
| 2006/0174373 A1 | 8/2006 | Gipmans et al. |
| 2006/0179511 A1 | 8/2006 | Chomet et al. |
| 2006/0183137 A1 | 8/2006 | Harper et al. |
| 2006/0195943 A1 | 8/2006 | Feldmann et al. |
| 2006/0206961 A1 | 9/2006 | Cirpus et al. |
| 2006/0260002 A1 | 11/2006 | Ronen et al. |
| 2006/0288451 A1 | 12/2006 | Val et al. |
| 2007/0006345 A1 | 1/2007 | Alexandrov et al. |
| 2007/0006346 A1 | 1/2007 | Alexandrov et al. |
| 2007/0044171 A1 | 2/2007 | Kovalic et al. |
| 2007/0044172 A1 | 2/2007 | Schneeberger et al. |
| 2007/0061916 A1 | 3/2007 | Kovalic et al. |
| 2007/0124833 A1 | 5/2007 | Abad et al. |
| 2007/0169219 A1 | 7/2007 | Nadzan et al. |
| 2007/0214517 A1* | 9/2007 | Alexandrov et al. .......... 800/278 |
| 2007/0261130 A1 | 11/2007 | Lightner et al. |
| 2008/0072340 A1* | 3/2008 | Troukhan et al. ............ 800/260 |
| 2008/0076179 A1 | 3/2008 | Hartel et al. |
| 2008/0148432 A1 | 6/2008 | Abad |
| 2008/0196120 A1 | 8/2008 | Wu et al. |
| 2008/0295196 A1* | 11/2008 | Abad et al. .................... 800/275 |
| 2008/0301839 A1 | 12/2008 | Ravanello |
| 2009/0089898 A1 | 4/2009 | Karchi et al. |
| 2009/0093620 A1 | 4/2009 | Kovalic et al. |
| 2009/0094717 A1 | 4/2009 | Troukhan et al. |
| 2009/0126042 A1 | 5/2009 | Ronen et al. |
| 2009/0260109 A1 | 10/2009 | Ronen et al. |
| 2009/0293154 A1 | 11/2009 | Yelin et al. |
| 2010/0037352 A1 | 2/2010 | Alexandrov et al. |
| 2010/0154077 A1 | 6/2010 | Emmanuel et al. |
| 2010/0319088 A1 | 12/2010 | Ronen et al. |
| 2011/0080674 A1 | 4/2011 | Durand |
| 2011/0214206 A1 | 9/2011 | La Rosa et al. |
| 2012/0060234 A1 | 3/2012 | Emmanuel et al. |
| 2012/0084885 A1 | 4/2012 | Alexandrov et al. |
| 2012/0096587 A1 | 4/2012 | Vinocur et al. |
| 2012/0180164 A1 | 7/2012 | Ayal et al. |
| 2012/0222169 A1 | 8/2012 | Ronen et al. |
| 2012/0297504 A1 | 11/2012 | Granevitze et al. |
| 2013/0167265 A1 | 6/2013 | Panik et al. |
| 2013/0219562 A1 | 8/2013 | Ronen et al. |
| 2013/0239255 A1 | 9/2013 | Ronen et al. |
| 2013/0276169 A1 | 10/2013 | Poraty et al. |
| 2013/0291223 A1 | 10/2013 | Emmanuel et al. |

FOREIGN PATENT DOCUMENTS

| | | |
|---|---|---|
| EP | 1033405 | 9/2000 |
| EP | 1225231 | 7/2002 |
| EP | 1945021 | 7/2008 |
| EP | 2154946 | 2/2010 |
| JP | 2005-052114 | 3/2005 |
| JP | 2005-185101 | 7/2005 |
| RU | 2350653 | 3/2009 |
| WO | WO 93/06710 | 4/1993 |
| WO | WO 93/07278 | 4/1993 |
| WO | WO 94/17194 | 8/1994 |
| WO | WO 95/08914 | 4/1995 |
| WO | WO 96/26639 | 9/1996 |
| WO | WO 96/40924 | 12/1996 |
| WO | WO 01/17333 | 3/2001 |
| WO | WO 01/40250 | 6/2001 |
| WO | WO 02/16655 | 2/2002 |
| WO | WO 02/45485 | 6/2002 |
| WO | WO 02/079403 | 10/2002 |
| WO | WO 02/090557 | 11/2002 |
| WO | WO 03/020025 | 3/2003 |
| WO | WO 03/087313 | 10/2003 |
| WO | WO 03/098186 | 11/2003 |
| WO | WO 2004/035798 | 4/2004 |
| WO | WO 2004/053055 | 6/2004 |
| WO | WO 2004/058963 | 7/2004 |
| WO | WO 2004/081173 | 9/2004 |
| WO | WO 2004/092367 | 10/2004 |
| WO | WO 2004/104162 | 12/2004 |
| WO | WO 2004/111183 | 12/2004 |
| WO | WO 2005/084331 | 9/2005 |
| WO | WO 2005/095614 | 10/2005 |
| WO | WO 2005/108422 | 11/2005 |
| WO | WO 2005/121364 | 12/2005 |
| WO | WO 2006/138012 | 12/2006 |
| WO | WO 2007/020638 | 2/2007 |
| WO | WO 2007/049275 | 5/2007 |
| WO | WO 2007/110314 | 10/2007 |
| WO | WO 2007/113237 | 10/2007 |
| WO | WO 2008/069878 | 6/2008 |
| WO | WO 2008/075364 | 6/2008 |
| WO | WO 2008/122980 | 10/2008 |
| WO | WO 2009/009142 | 1/2009 |
| WO | WO 2009/013750 | 1/2009 |
| WO | WO 2009/083958 | 7/2009 |
| WO | WO 2009/141824 | 11/2009 |
| WO | WO 2009/144311 | 12/2009 |
| WO | WO 2010/020941 | 2/2010 |
| WO | WO 2010/049897 | 5/2010 |
| WO | WO 2010/076756 | 7/2010 |
| WO | WO 2010/100595 | 9/2010 |
| WO | WO 2010/143138 | 12/2010 |
| WO | WO 2011/015985 | 2/2011 |
| WO | WO 2011/080674 | 7/2011 |
| WO | WO 2011/135527 | 11/2011 |
| WO | WO 2012/028993 | 3/2012 |
| WO | WO 2012/085862 | 6/2012 |
| WO | WO 2012/150598 | 11/2012 |

(56) References Cited

FOREIGN PATENT DOCUMENTS

| WO | WO 2013/027223 | 2/2013 |
|----|----------------|--------|
| WO | WO 2013/128448 | 9/2013 |
| WO | WO 2013/179211 | 12/2013 |

OTHER PUBLICATIONS

Zhou et al. Global genome expression analysis of rice in repsonse to drought and high-salinity stresses in shoot, flag leaf, and panicle. Plant Molecular Biology. 2007. 63: 591-608.*

Clontech. GenomeWalker Universal Kit User Manual. Clontech Laboratories. 2007. pp. 1-30.*

Notice of Allowance Dated Nov. 19, 2012 From the US Patent and Trademark Office Re. U.S. Appl. No. 13/450,547.

Communication Pursuant to Article 94(3) EPC Dated Oct. 23, 2012 From the European Patent Office Re. Application No. 11154213.0.

Examination Report Dated Oct. 15, 2012 From the Instituto Mexicano de la Propiedad Industrial Re. Application No. MX/a/2009/006660 and its Translation Into English.

Patent Examination Report Dated Dec. 12, 2012 From the Australian Government, IP Australia Re. Application No. 2008236316.

Communication Pursuant to Article 94(3) EPC Dated Dec. 19, 2012 From the European Patent Office Re.: Application No. 04734072.4.

Official Action Dated Dec. 18, 2012 From the US Patent and Trademark Office Re. U.S. Appl. No. 12/834,106.

Benfey et al. "The CaMV 35S Enhancer Contains at Least Two Domains Which Can Confer Different Development and Tissue-Specific Expression Patterns", The EMBO Journal, 8(8): 2195-2202, 1989.

Benfey et al. "The Cauliflower Mosaic Virus 35S Promoter: Combinatorial Regulation of Transcription in Plants", Science, 250(4983): 959-966, Nov. 16, 1990.

Examination Report Dated Jun. 11, 2012 From the Instituto Mexicano de la Propiedad Industrial Re. Application No. MX/a/2011/007294 and Summary in English.

Communication Pursuant to Article 94(3) EPC Dated Oct. 23, 2012 From the European Patent Office Re. Application No. 11154193.4.

Requisition by the Examiner Dated Oct. 3, 2012 From the Canadian Intellectual Property Office Re. Application No. 2,526,440.

Translation of Notice of Paying Restoration Fee for Unity of Invention Dated Oct. 29, 2012 From the State Intellectual Property Office of the People's Republic of China Re. Application No. 200880127757.X.

Alcala et al. "EST543159 Tomato Callus *Solanum lycopersicum* cDNA Clone cLEC80A19 5-end, mRNA Sequence", GenBank: BI923254.1, GenBank Accession No. BI923254, Oct. 17, 2001.

Communication Pursuant to Article 94(3) EPC Dated Jan. 3, 2013 From the European Patent Office Re. Application No. 09807983.3.

English Summary of Examination Results Dated Dec. 28, 2012 From the National Office of Intellectual Property (NOIP) of Vietnam Re. Application No. 1-2009-02358.

International Search Report and the Written Opinion Dated Jan. 7, 2013 From the International Searching Authority Re. Application No. PCT/IL2012/050154.

Invitation to Pay Additional Fees Dated Dec. 31, 2012 From the International Searching Authority Re. Application No. PCT/IL2012/050327.

International Search Report and the Written Opinion Dated Jun. 2, 2010 From the International Searching Authority Re.: Application No. PCT/IB09/54774.

Translation of Examination Report Dated Sep. 6, 2010 From the Government of the People's Republic of Bangladesh, Department of Patents, Designs and Trademarks, Ministry of Industries Re. Application No. 275/2009.

Bautista et al. "*Arabidopsis thaliana* At5g06690 mRNA, Complete Cds", Unpublished, The Salk Institute for Biological Studies, La Jolla, CA USA, GenBank: BT029447, Nov. 15, 2006.

Supplementary European Search Report and the European Search Opinion Dated Apr. 18, 2012 From the European Patent Office Re. Application No. 09823171.5.

Cheuk et al. "*Arabidopsis thaliana* At2g40550 Gene, Complete CDS", Database EMBL [Online], XP002673499, Retrieved From EBI Accession No. EM_PL: BT022032.1, Database Accession No. BT022032, May 4, 2005.

Rounsley et al. "*Arabidopsis thaliana* Chromosome 2 Clone T2P4 Map CIC10A06, Complete Sequence", Database EMBL [Online], XP002673500, Retrieved From EBI Accession No. EMBL:AC002336, Database Accession No. AC002336, Jul. 18, 1997. Sequence.

Takahashi et al. "The DNA Replication Checkpoint Aids Survival of Plants Deficient in the Novel Replisome Factor ETG1", The EMBO Journal, XP002537888, 27(13): 1840-1851, Jul. 9, 2008. Suppl. Fig. S6, p. 1844-1845.

International Preliminary Report on Patentability Dated May 12, 2011 From the International Bureau of WIPO Re. Application No. PCT/IB2009/054774.

Communication Pursuant to Rules 70(2) and 70a(2) EPC Dated May 7, 2012 From the European Patent Office Re. Application No. 09823171.5.

Examination Report Dated Jun. 25, 2012 From the Instituto Mexicano de la Propiedad Industrial Re. Application No. MX/a/2011/003575 and its Translation Into English.

International Preliminary Report on Patentability Dated Apr. 12, 2012 From the Interantional Bureau of WIPO Re. Application No. PCT/IB2010/052545.

International Search Report and the Written Opinion Dated Mar. 16, 2012 From the International Searching Authority Re. Application No. PCT/IB2010/052545.

Invitation to Pay Additional Fees Dated Dec. 27, 2011 From the International Searching Authority Re. Application No. PCT/IB2010/052545.

Castelli et al. "*Arabidopsis thaliana* Full-Length cDNA Complete Sequence From Clone GSLTFB52ZA10 of Flowers and Buds of Strain Col-0 of *Arabidopsis thaliana* (Thale Cress)", GeneBank Direct Submission BX829993, Accession No. BX829993, Feb. 6, 2004.

Good et al. "Can Less Yield More? Is Reducing Nutrient Input Into the Environment Compatible With Maintaining Crop Production?", Trends in Plant Science, 9(12): 597-605, Dec. 2004.

Good et al. "Engineering Nitrogen Use Efficiency With Alanine Aminotransferase", Canadian Journal of Botany, 85: 252-262, 2007.

Yanagisawa et al. "Metabolic Engineering With Dof1 Transcription Factor in Plants: Improved Nitrogen Assimilation and Growth Under Low-Nitrogen Conditions", Proc. Natl. Acad. Sci USA, PNAS, 101(20): 7833-7838, May 18, 2004.

Communication Pursuant to Article 94(3) EPC Dated Dec. 2008 From the European Patent Office Re.: Application No. 04734072.4.

International Preliminary Report on Patentability Dated Dec. 8, 2005 From the International Bureau of WIPO Re.: Application No. PCT/IL2004/000431.

International Preliminary Report on Patentability Dated Jan. 22, 2009 From the International Bureau of WIPO Re.: Application No. PCT/IL2006/001223.

Invitation to Pay Additional Fees Dated Feb. 7, 2008 From the International Searching Authority Re.: Application No. PCT/IL06/001223.

Invitation to Pay Additional Fees Dated Dec. 18, 2008 From the International Searching Authority Re.: Application No. PCT/IL08/01024.

Advisory Action Before the Filing of an Appeal Brief Dated Aug. 5, 2011 From the US Patent and Trademark Office Re. U.S. Appl. No. 12/083,978.

Advisory Action Before the Filing of an Appeal Brief Dated Aug. 29, 2012 From the US Patent and Trademark Office Re. U.S. Appl. No. 12/457,199.

Applicant-Initiated Interview Summary Dated Aug. 6, 2012 From the US Patent and Trademark Office Re. U.S. Appl. No. 12/669,975.

Communication Pursuant to Article 93(3) EPC Dated Jun. 15, 2012 From the European Patent Office Re. Application No. 11154193.4.

Communication Pursuant to Article 94(3) EPC Dated Apr. 3, 2012 From the European Patent Office Re.: Application No. 06766224.7.

Communication Pursuant to Article 94(3) EPC Dated Jul. 4, 2012 From the European Patent Office Re. Application No. 10194223.3.

(56) References Cited

OTHER PUBLICATIONS

Communication Pursuant to Article 94(3) EPC Dated Mar. 8, 2011 From the European Patent Office Re.: Application No. 06809784.9.
Communication Pursuant to Article 94(3) EPC Dated Nov. 8, 2010 From the European Patent Office Re.: Application No. 04734072.4.
Communication Pursuant to Article 94(3) EPC Dated Sep. 9, 2009 From the European Patent Office Re.: Application No. 04734072.4.
Communication Pursuant to Article 94(3) EPC Dated May 12, 2010 From the European Patent Office Re.: Application No. 06766224.7.
Communication Pursuant to Article 94(3) EPC Dated Feb. 13, 2009 From the European Patent Office Re.: Application No. 05750089.4.
Communication Pursuant to Article 94(3) EPC DAted Jul. 13, 2012 From the European Patent Office Re. Application No. 11172514.9.
Communication Pursuant to Article 94(3) EPC Dated Feb. 14, 2012 From the European Patent Office Re.: Application No. 04734072.4.
Communication Pursuant to Article 94(3) EPC Dated Mar. 14, 2011 From the European Patent Office Re. Application No. 07849616.3.
Communication Pursuant to Article 94(3) EPC Dated Nov. 19, 2010 From the European Patent Office Re.: Application No. 06809784.9.
Communication Pursuant to Article 94(3) EPC Dated Jun. 21, 2012 From the European Patent Office Re. Application No. 11154213.0.
Communication Pursuant to Article 94(3) EPC Dated Nov. 27, 2009 From the European Patent Office Re.: Application No. 06809784.9.
Communication Pursuant to Article 94(3) EPC Dated Jun. 29, 2011 From the European Patent Office Re. Application No. 08738191.9.
Communication Pursuant to Rule 55 EPC Dated Mar. 16, 2012 From the European Patent Office Re. Application No. 11190921.4.
Communication Pursuant to Rule 58 EPC or Rule 159 EPC, Invitation to Remedy Deficiencies in the Application Documents Dated Jan. 19, 2012 From the European Patent Office Re. Application No. 11190922.2.
Communication Pursuant to Rule 69 EPC—Reminder Concerning Payment of the Designation Fee (Art. 79(2) EPC) and of the Examination Fee (Art. 94(1) EPC)—and Invitation Pursuant to Rule 70a(1) EPC Dated Jul. 18, 2011 From the European Patent Office Re. Application No. 11154193.4.
Communication Pursuant to Rule 69 EPC—Reminder Concerning Payment of the Designation Fee (Art. 79(2) EPC) and of the Examination Fee (Art. 94(1) EPC)—and Invitation Pursuant to Rule 70a(1) EPC Dated Jul. 25, 2011 From the European Patent Office Re. Application No. 11154213.0.
Communication Pursuant to Rule 70(2) EPC and Reference to Rule 39(1) EPC Dated Sep. 13, 2010 From the European Patent Office Re.: Application No. 09163033.5.
Communication Pursuant to Rules 70(2) and 70a(2) EPC and Reference to Rule 39(1) EPC Dated Dec. 5, 2011 From the European Patent Office Re. Application No. 10194223.3.
Communication Pursuant to Rules 70(2) and 70a(2) EPC and Reference to Rule 39(1) EPC Dated Nov. 7, 2011 From the European Patent Office Re. Application No. 11172514.9.
Communication Pursuant to Rules 70(2) and 70a(2) EPC Dated Jan. 19, 2012 From the European Patent Office Re. Application No. 09807983.3.
Communication Pursuant to Rules 70(2) and 70a(2) EPC Dated Jul. 24, 2012 From the European Patent Office Re. Application No. 10748403.2.
Communication Pursuant to Rules 70(2) and 70a(2) EPC Dated May 24, 2011 From the European Patent Office Re. Application No. 09750276.9.
Communication Relating to the Results of the Partial International Search Dated Jul. 8, 2009 From the International Searching Authority Re.: Application No. PCT/IL2008/001657.
Communication Under Rule 71(3) EPC Dated Jun. 5, 2012 From the European Patent Office Re.: Application No. 06809784.9.
Communiciation Pursuant to Rules 70(2) and 70a(2) EPC Dated Aug. 30, 2010 From the European Patent Office Re. Application No. 08738191.9.
Decision on Granting a Patent for Invention Dated Dec. 7, 2010 From the ROSPATENT, Federal State Institution, Federal Institute for Industrial Property of the Federal Service for Intellectual Property, Patents and Trademarks of the Russian Federation Re. Application No. 2008120395 and its Translation Into English.
European Search Report and the European Search Opinion Dated Nov. 2, 2011 From the European Patent Office Re. Application No. 10194223.3.
European Search Report and the European Search Opinion Dated Oct. 6, 2011 From the European Patent Office Re. Application No. 11172514.9.
European Search Report and the European Search Opinion Dated Aug. 9, 2010 From the European Patent Office Re.: Application No. 09163033.5.
European Search Report and the European Search Opinion Dated Jun. 14, 2011 From the European Patent Office Re. Application No. 11154193.4.
European Search Report and the European Search Opinion Dated Jun. 21, 2011 From the European Patent Office Re. Application No. 11154213.0.
Examination Report Dated Aug. 1, 2011 From the Government of India, Patent Office Re.: Application No. 158/CHENP/2007.
Examination Report Dated Nov. 3, 2010 From the Government of India, Patent Office Re.: Application No. 158/CHENP/2007.
Examination Report Dated Jun. 6, 2012 From the Federal Service of Intellectual Property, Federal State Budget Institute, Federal Institute of Industrial Property of the Russian Federation Re. Application No. 2011113420 and its Translation Into English.
Examination Report Dated Jun. 11, 2012 From the Instituto Mexicano de la Propiedad Industrial Re. Application No. MX/a/2011/007294 and its Translation Into English.
Examination Report Dated Nov. 13, 2007 From the Government of India, Patent Office Re.: Application No. 3482/CHENP/2005.
Examination Report Dated Sep. 14, 2012 From the Australian Government IP Australia Re. Application No. 2007335706.
Examination Report Dated Aug. 16, 2012 From the Instituto Mexicano de la Propiedad Industrial Re. Application No. MX/a/2010/014097 and its Translation Into English.
Examination Report Dated Feb. 17, 2010 From the Instituto Mexicano de la Propriedad Industrial Re. Application No. PA/a/2005/012565 and its Summary in English.
Examination Report Dated Apr. 19, 2011 From the Instituto Mexicano de la Propriedad Industrial Re. Application No. MX/a/2008/002262 and its Summary Into English.
Examination Report Dated Dec. 19, 2011 From the Federal Service of Intellectual Property, Federal State Budget Institute, Federal Institute of Industrial Property of the Russian Federation Re. Application No. 2011113420 and its Translation Into English.
Examination Report Dated Sep. 22, 2010 From the Instituto Mexicano de la Propriedad Industrial Re. Application No. MX/a/2008/005280 and its Summary Into English.
Examination Report Dated May 25, 2011 From the Government of India, Patent Office Re.: Application No. 158/CHENP/2007.
Examiner's Report Dated Aug. 1, 2011 From the Australian Government, IP Australia Re. Application No. 2005234725.
Examiner's Report Dated Jan. 10, 2012 From the Australian Government, IP Australia Re. Application No. 2005234725.
Examiner's Report Dated Jan. 13, 2011 From the Australian Government, IP Australia Re.: Application No. 2005252469.
Examiner's Report Dated Jan. 13, 2012 From the Australian Government, IP Australia Re. Application No. 2011239323.
Examiner's Report Dated Mar. 15, 2012 From the Australian Government, IP Australia Re. Application No. 2011239323.
Examiner's Report Dated Dec. 17, 2009 From the Australian Government, IP Australia Re.: Application No. 2005252469.
Examiner's Report Dated Oct. 19, 2011 From the Australian Government, IP Australia Re. Application No. 2006281018.
Examiner's Report Dated Dec. 20, 2010 From the Australian Government, IP Australia Re. Application No. 2005234725.
Examiner's Report Dated Jul. 21, 2011 From the Australian Government, IP Australia Re. Application No. 2005234725.
Examiner's Report Dated Jun. 24, 2011 From the Australian Government, IP Australia Re. Application No. 2006281018.
Examiner's Report Dated Oct. 28, 2011 From the Australian Government, IP Australia Re. Application No. 2006307457.

(56) References Cited

OTHER PUBLICATIONS

Examiner's Report Dated Jun. 30, 2011 From the Australian Government, IP Australia Re. Application No. 2006307457.
Examiner's Report Dated Jan. 31, 2012 From the Australian Government, IP Australia Re. Application No. 2006281018.
Examiner's Report Dated Mar. 31, 2011 From the Australian Government, IP Australia Re.: Application No. 2005252469.
International Preliminary Report on Patentability Dated Dec. 1, 2011 From the International Bureau of WIPO Re. Application No. PCT/IL2008/000489.
International Preliminary Report on Patentability Dated Dec. 2, 2010 From the International Bureau of WIPO Re. Application No. PCT/IL2009/000508.
International Preliminary Report on Patentability Dated Mar. 3, 2011 From the International Bureau of WIPO Re.: Application No. PCT/IB2009/053633.
International Preliminary Report on Patentability Dated Feb. 4, 2010 From the International Bureau of WIPO Re.: Application No. PCT/IL2008/001024.
International Preliminary Report on Patentability Dated Jul. 8, 2010 From the International Bureau of WIPO Re.: Application No. PCT/IL2008/001657.
International Preliminary Report on Patentability Dated Jul. 12, 2012 From the International Bureau of WIPO Re. Application No. PCT/IB2010/056023.
International Preliminary Report on Patentability Dated Jan. 14, 2010 From the International Bureau of WIPO Re.: Application No. PCT/IL2008/000489.
International Preliminary Report on Patentability Dated Sep. 15, 2011 From the International Bureau of WIPO Re. Application No. PCT/IB2010/050871.
International Preliminary Report on Patentability Dated Jan. 21, 2010 From the International Bureau of WIPO Re.: Application No. PCT/IL2007/001590.
International Preliminary Report on Patentability Dated Jan. 22, 2009 From the International Bureau of WIPO Re.: Application No. PCT/IL2006/000947.
International Preliminary Report on Patentability Dated Mar. 29, 2007 From the International Bureau of WIPO Re.: Application No. PCT/IL2005/000627.
International Preliminary Report on Patentability Dated Jan. 30, 2007 From the International Bureau of WIPO Re.: Application No. PCT/IL05/00627.
International Search Report and the Written Opinion Dated Jun. 20, 2010 From the International Searching Authority Re. Application No. PCT/IB09/53633.
International Search Report and the Written Opinion Dated Aug. 6, 2012 From the International Searching Authority Re. Application No. PCT/IB11/53697.
International Search Report and the Written Opinion Dated Dec. 6, 2011 From the International Searching Authority Re. Application No. PCT/IB2011/051843.
International Search Report and the Written Opinion Dated Sep. 6, 2012 From the International Searching Authority Re. Application No. PCT/IB2011/055854.
International Search Report and the Written Opinion Dated Sep. 7, 2010 From the International Searching Authority Re. Application No. PCT/IB10/50871.
International Search Report and the Written Opinion Dated Feb. 17, 2010 From the International Searching Authority Re.: Application No. PCT/IL09/00508.
International Search Report and the Written Opinion Dated Aug. 22, 2011 From the International Searching Authority Re. Application No. PCT/IB2010/056023.
International Search Report and the Written Opinion Dated Nov. 24, 2008 From the International Searching Authority Re.: Application No. PCT/IL08/00489.
International Search Report and the Written Opinion Dated Jul. 29, 2008 From the International Searching Authority Re.: Application No. PCT/IL06/001223.
International Search Report and the Written Opinion Dated Oct. 30, 2009 From the International Searching Authority Re.: Application No. PCT/IL2008/001657.
International Search Report and the Written Opinion Dated Oct. 31, 2011 From the International Searching Authority Re.: Application No. PCT/IL08/00489.
International Search Report Dated Jul. 2, 2009 From the International Searching Authority Re.: Application No. PCT/IL07/01590.
International Search Report Dated Jan. 3, 2007 From the International Searching Authority Re.: Application No. PCT/IL2005/000627.
International Search Report Dated Mar. 4, 2009 From the International Searching Authority Re.: Application No. PCT/IL08/01024.
International Search Report Dated Nov. 4, 2005 From the International Searching Authority Re.: Application No. PCT/IL04/00431.
International Search Report Dated Aug. 27, 2008 From the International Searching Authority Re.: Application No. PCT/IL06/00947.
Invitation to Pay Additional Fees Dated Mar. 2, 2010 From the International Searching Authority Re.: Application No. PCT/IB09/53633.
Invitation to Pay Additional Fees Dated May 8, 2012 From the International Searching Authority Re. Application No. PCT/IB11/53697.
Invitation to Pay Additional Fees Dated Sep. 8, 2006 From the International Searching Authority Re.: Application No. PCT/IL05/00627.
Invitation to Pay Additional Fees Dated Jun. 9, 2011 From the International Searching Authority Re. Application No. PCT/IB2010/056023.
Invitation to Pay Additional Fees Dated Jun. 15, 2012 From the International Searching Authority Re. Application No. PCT/IB2011/055854.
Invitation to Pay Additional Fees Dated Aug. 18, 2011 From the International Searching Authority Re.: Application No. PCT/IL08/00489.
Invitation to Pay Additional Fees Dated Nov. 19, 2009 From the International Searching Authority Re.: Application No. PCT/IL09/00508.
Invitation to Pay Additional Fees Dated Aug. 23, 2005 From the International Search Authority Re. Application No. PCT/IL2004/000431.
Notice of Allowance Dated Dec. 5, 2011 From the US Patent and Trademark Office Re. U.S. Appl. No. 12/448,359.
Notice of Allowance Dated Aug. 11, 2010 From the Instituto Mexicano de la Propriedad Industrial Re. Application No. PA/a/2005/012565.
Notice of Allowance Dated Apr. 16, 2010 From the US Patent and Trademark Office Re.: U.S. Appl. No. 11/629,411.
Notice of Allowance Dated Oct. 18, 2010 From the US Patent and Trademark Office Re.: U.S. Appl. No. 11/990,386.
Notice of Grant Dated Jan. 14, 2011 From the Instituto Mexicano de la Propriedad Industrial Re. Application No. MX/a/2008/005280.
Office Action Dated Jan. 2, 2012 From the Israel Patent Office Re. Application No. 206118 and its Translation Into English.
Office Action Dated Feb. 3, 2011 From the Israel Patent Office Re.: Application No. 172135 and its Translation Into English.
Office Action Dated Aug. 4, 2010 From the Israel Patent Office Re.: Application No. 172135 and its Translation Into English.
Office Action Dated Jan. 9, 2009 From the State Intellectual Property Office of the People's Republic of China Re.: Application No. 200480020597.0.
Office Action Dated Nov. 11, 2010 From the Israel Patent Office Re. Application No. 206118 and its Translation Into English.
Office Action Dated May 13, 2010 From the Israel Patent Office Re. Application No. 180022 and its Translation Into English.
Office Action Dated Jun. 17, 2010 From the Israel Patent Office Re. Application No. 190918 and its Translation Into English.
Office Action Dated Oct. 18, 2010 From the Israel Patent Office Re. Application No. 180022 and its Translation Into English.
Office Action Dated Jun. 19, 2011 From the Israel Patent Office Re. Application No. 199391 and its Translation Into English.
Office Action Dated Jun. 20, 2011 From the Israel Patent Office Re. Application No. 190918 and its Translation Into English.

(56) References Cited

OTHER PUBLICATIONS

Office Action Dated Jan. 22, 2010 From the State Intellectual Property Office of the People's Republic of China Re.: Application No. 200580027481.4 and its Translation Into English.
Office Action Dated Sep. 22, 2011 From the Israeli Patent Office Re. Application No. 201242 and its Translation Into English.
Office Action Dated Jun. 25, 2012 From the State Intellectual Property Office of the People's Republic of China Re.: Application No. 200880109464.9 and its Translation Into English.
Office Action Dated Apr. 27, 2009 From the Israeli Patent Office Re.: Application No. 172135 and its Translation Into English.
Office Action Dated Jan. 31, 2010 From the Israel Patent Office Re.: Application No. 172135 and its Translation Into English.
Office Letter Dated Jul. 7, 2008 From the Government of India, Patent Office Re.: Application No. 3482/CHENP/2005.
Official Action Dated May 1, 2009 From the US Patent and Trademark Office Re.: U.S. Appl. No. 11/629,411.
Official Action Dated Sep. 2, 2009 From the US Patent and Trademark Office Re.: U.S. Appl. No. 11/629,411.
Official Action Dated Jul. 8, 2011 From the US Patent and Trademark Office Re. U.S. Appl. No. 12/083,978.
Official Action Dated Jun. 8, 2010 From the US Patent and Trademark Office Re.: U.S. Appl. No. 11/629,411.
Official Action Dated Apr. 10, 2012 From the US Patent and Trademark Office Re. U.S. Appl. No. 12/669,975.
Official Action Dated May 10, 2011 From the US Patent and Trademark Office Re. U.S. Appl. No. 12/457,199.
Official Action Dated Jun. 13, 2012 From the US Patent and Trademark Office Re. U.S. Appl. No. 12/594,853.
Official Action Dated May 14, 2012 From the US Patent and Trademark Office Re. U.S. Appl. No. 12/457,199.
Official Action Dated Feb. 15, 2011 From the US Patent and Trademark Office Re. U.S. Appl. No. 12/448,359.
Official Action Dated May 15, 2009 From the US Patent and Trademark Office Re.: U.S. Appl. No. 11/990,386.
Official Action Dated Jul. 17, 2012 From the US Patent and Trademark Office Re. U.S. Appl. No. 12/834,106.
Official Action Dated Aug. 18, 2010 From the US Patent and Trademark Office Re. U.S. Appl. No. 12/083,978.
Official Action Dated Oct. 18, 2007 From the US Patent and Trademark Office Re.: U.S. Appl. No. 11/284,236.
Official Action Dated Jun. 19, 2012 From the US Patent and Trademark Office Re. U.S. Appl. No. 13/450,547.
Official Action Dated Sep. 19, 2011 From the US Patent and Trademark Office Re. U.S. Appl. No. 12/810,855.
Official Action Dated Dec. 21, 2011 From the US Patent and Trademark Office Re. U.S. Appl. No. 12/810,855.
Official Action Dated Aug. 22, 2011 From the US Patent and Trademark Office Re. U.S. Appl. No. 12/457,199.
Official Action Dated Oct. 22, 2009 From the US Patent and Trademark Office Re.: U.S. Appl. No. 11/990,386.
Official Action Dated Nov. 23, 2010 From the US Patent and Trademark Office Re. U.S. Appl. No. 12/083,978.
Official Action Dated Jul. 28, 2008 From the US Patent and Trademark Office Re.: U.S. Appl. No. 11/284,236.
Official Action Dated Apr. 29, 2011 From the US Patent and Trademark Office Re. U.S. Appl. No. 12/448,359.
Partial European Search Report Dated Jul. 12, 2011 From the European Patent Office Re. Application No. 10194223.3.
Partial European Search Report Dated Apr. 19, 2010 From the European Patent Office Re.: Application No. 09163033.5.
Requisition by the Examiner Dated Feb. 2, 2012 From the Canadian Intellectual Property Office Re. Application No. 2,570,195.
Requisition by the Examiner Dated Jun. 15, 2011 From the Canadian Intellectual Property Office Re. Application No. 2,526,440.
Response Dated Jun. 2, 2011 to Office Action of Feb. 3, 2011 From the Israel Patent Office Re.: Application No. 172135.
Response Dated Jul. 3, 2011 to Examination Report of Apr. 19, 2011 From the Instituto Mexicano de la Propriedad Industrial Re. Application No. MX/a/2008/002262 and its Summary Into English.
Response Dated Oct. 3, 2011 to Examiner's Report of Jun. 24, 2011 From the Australian Government, IP Australia Re. Application No. 2006281018.
Response Dated Jan. 4, 2010 to Official Action of Sep. 2, 2009 From the US Patent and Trademark Office Re.: U.S. Appl. No. 11/629,411.
Response Dated Oct. 4, 2011 to Official Action of Jul. 8, 2011 From the US Patent and Trademark Office Re. U.S. Appl. No. 12/083,978.
Response Dated Dec. 5, 2010 to Office Action of Aug. 4, 2010 From the Israel Patent Office Re.: Application No. 172135.
Response Dated Jul. 6, 2011 to Examiner's Report of Dec. 20, 2010 From the Australian Government, IP Australia Re. Application No. 2005234725.
Response Dated Jun. 6, 2011 to Official Action of May 10, 2011 From the US Patent and Trademark Office Re. U.S. Appl. No. 12/457,199.
Response Dated Jan. 7, 2010 to Communication Pursuant to Article 94(3) EPC of Sep. 9, 2009 From the European Patent Office Re.: Application No. 04734072.4.
Response Dated Mar. 8, 2011 to Examiner's Report of Jan. 13, 2011 From the Australian Government, IP Australia Re.: Application No. 2005252469.
Response Dated Feb. 9, 2011 to Communication Pursuant to Article 94(3) EPC of Nov. 19, 2010 From the European Patent Office Re.: Application No. 06809784.9.
Response Dated Jun. 9, 2011 to Examiner's Report of Dec. 20, 2011 From the Australian Government, IP Australia Re. Application No. 2005234725.
Response Dated Mar. 9, 2011 to Office Action of Nov. 11, 2010 From the Israel Patent Office Re. Application No. 206118.
Response Dated Jan. 10, 2012 to European Search Report and the European Search Opinion of Jun. 14, 2011 From the European Patent Office Re. Application No. 11154193.4.
Response Dated Aug. 11, 2011 to Examination Report of Aug. 1, 2011 From the Government of India, Patent Office Re.: Application No. 158/CHENP/2007.
Response Dated Dec. 12, 2010 to Examiner's Report of Dec. 17, 2009.
Response Dated Oct. 12, 2010 to Communication Pursuant to Article 94(3) EPC of May 12, 2010 From the European Patent Office Re.: Application No. 06766224.7.
Response Dated Sep. 13, 2010 to Office Action Dated May 13, 2010 From the Israel Patent Office Re. Application No. 180022.
Response Dated Dec. 14, 2010 to Examination Report of Sep. 22, 2010 From the Instituto Mexicano de la Propriedad Industrial Re. Application No. MX/a/2008/005280.
Response Dated Feb. 14, 2011 to Supplementary European Search Report and the European Search Opinion of Jul. 29, 2010 From the European Patent Office Re. Application No. 08776651.5.
Response Dated Mar. 14, 2011 to Official Action of Feb. 15, 2011 From the US Patent and Trademark Office Re. U.S. Appl. No. 12/448,359.
Response Dated Oct. 14, 2010 to Office Action of Jun. 17, 2010 From the Israel Patent Office Re. Application No. 190918.
Response Dated Sep. 14, 2010 to Official Action of Aug. 18, 2010 From the US Patent and Trademark Office Re. U.S. Appl. No. 12/083,978.
Response Dated Dec. 15, 2011 to Examiner's Report of Aug. 1, 2011 From the Australian Government, IP Australia Re. Application No. 2005234725.
Response Dated Jun. 15, 2011 to Examiner's Report of Mar. 31, 2011 From the Australian Government, IP Australia Re.: Application No. 2005252469.
Response Dated Jun. 17, 2011 to Examiner's Report of Mar. 31, 2011 From the Australian Government, IP Australia Re.: Application No. 2005252469.
Response Dated May 17, 2010 to Office Action of Jan. 22, 2010 From the State Intellectual Property Office of the People's Republic of China Re.: Application No. 200580027481.4.
Response Dated Oct. 17, 2011 to Requisition by the Examiner of Jun. 15, 2011 From the Canadian Intellectual Property Office Re. Application No. 2,526,440.
Response Dated Oct. 18, 2011 to Official Action of Sep. 19, 2011 From the US Patent and Trademark Office Re. U.S. Appl. No. 12/810,855.

(56) References Cited

OTHER PUBLICATIONS

Response Dated Dec. 19, 2011 to Examiner's Report of Oct. 19, 2011 From the Australian Government, IP Australia Re. Application No. 2006281018.

Response Dated Jan. 19, 2011 to Supplementary European Search Report and the European Search Opinion of Jul. 1, 2010 From the European Patent Office Re. Application No. 07849616.3.

Response Dated Oct. 19, 2011 to Official Action of Apr. 29, 2011 From the US Patent and Trademark Office Re. U.S. Appl. No. 12/448,359.

Response Dated Jul. 20, 2011 to Examination Report of May 25, 2011 From the Government of India, Patent Office Re.: Application No. 158/CHENP/2007.

Response Dated Apr. 21, 2011 to Communication Pursuant to Article 94(3) EPC of Nov. 8, 2010 From the European Patent Office Re.: Application No. 04734072.4.

Response Dated Sep. 21, 2010 to Notice of Allowance of Apr. 16, 2010 From the US Patent and Trademark Office Re.: U.S. Appl. No. 11/629,411.

Response Dated Dec. 22, 2011 to Official Action of Aug. 22, 2011 From the US Patent and Trademark Office Re. U.S. Appl. No. 12/457,199.

Response Dated Feb. 22, 2010 to Official Action of Oct. 22, 2009 From the US Patent and Trademark Office Re.: U.S. Appl. No. 11/990,386.

Response Dated Feb. 23, 2011 to Communication Pursuant to Rule 70(2) EPC and Reference to Rule 39(1) EPC of Sep. 13, 2010 From the European Patent Office Re.: Application No. 09163033.5.

Response Dated Mar. 23, 2011 to Official Action of Nov. 23, 2010 From the US Patent and Trademark Office Re. U.S. Appl. No. 12/083,978.

Response Dated Feb. 24, 2011 to Communciation Pursuant to Rules 70(2) and 70a(2) EPC of Aug. 30, 2010 From the European Patent Office Re. Application No. 08738191.9.

Response Dated Mar. 24, 2011 to Examination Report of Nov. 3, 2010 From the Government of India, Patent Office Re.: Application No. 158/CHENP/2007.

Response Dated Oct. 24, 2010 to Office Action of Sep. 2, 2010 From the ROSPATENT, Federal State Institution, Federal Institute for Industrial Property of the Federal Service for Intellectual Property, Patents and Trademarks of the Russian Federation Re. Application No. 2008120395.

Response Dated Jul. 25, 2011 to Examiner's Report of Jul. 21, 2011 From the Australian Government, IP Australia Re. Application No. 2005234725.

Response Dated Sep. 25, 2011 to Examiner's Report of Jun. 30, 2011 From the Australian Government, IP Australia Re. Application No. 2006307457.

Response Dated Oct. 27, 2011 to Communication Pursuant to Article 94(3) EPC of Jun. 29, 2011 From the European Patent Office Re. Application No. 08738191.9.

Response Dated Oct. 27, 2011 to Office Action of Jul. 21, 2011 From the State Intellectual Property Office of the People's Republic of China Re. Application No. 200880017707.6.

Response Dated Oct. 27, 2011 to Supplementary European Search Report and the European Search Opinion of May 6, 2011 From the European Patent Office Re. Application No. 09750276.9.

Response Dated Jun. 29, 2010 to Examination Report of Feb. 17, 2010 From the Instituto Mexicano de la Propriedad Industrial Re. Application No. PA/a/2005/012565.

Response Dated Jun. 29, 2011 to Communication Pursuant to Article 94(3) EPC of Mar. 8, 2011 From the European Patent Office Re.: Application No. 06809784.9.

Response Dated May 31, 2010 to Office Action of Jan. 31, 2010 From the Israel Patent Office Re.: Application No. 172135.

Response Dated Oct. 31, 2011 to Notification of the First Office Action of Jun. 30, 2011 From the State Intellectual Property Office of the People's Republic of China Re. Application No. 200680047610.0.

Restriction Official Action Dated Feb. 1, 2012 From the US Patent and Trademark Office Re. U.S. Appl. No. 12/669,975.

Restriction Official Action Dated Apr. 11, 2012 From the US Patent and Trademark Office Re. U.S. Appl. No. 12/834,106.

Restriction Official Action Dated Feb. 13, 2012 From the US Patent and Trademark Office Re. U.S. Appl. No. 12/594,853.

Summary of Office Action Dated Sep. 2, 2010 From the ROSPATENT, Federal State Institution, Federal Institute for Industrial Property of the Federal Service for Intellectual Property, Patents and Trademarks of the Russian Federation Re. Application No. 2008120395.

Supplementary European Search Report and the European Search Opinion Dated Feb. 1, 2010 From the European Patent Office Re.: Application No. 06766224.7.

Supplementary European Search Report and the European Search Opinion Dated Jul. 1, 2010 From the European Patent Office Re. Application No. 07849616.3.

Supplementary European Search Report and the European Search Opinion Dated Jan. 2, 2012 From the European Patent Office Re. Application No. 09807983.3.

Supplementary European Search Report and the European Search Opinion Dated Jul. 6, 2012 From the European Patent Office Re. Application No. 10748403.2.

Supplementary European Search Report and the European Search Opinion Dated May 6, 2011 From the European Patent Office Re. Application No. 09750276.9.

Supplementary European Search Report and the European Search Opinion Dated Aug. 11, 2010 From the European Patent Office Re. Application No. 08738191.9.

Supplementary European Search Report and the European Search Opinion Dated Sep. 14, 2009 From the European Patent Office Re.: Application No. 06809784.9.

Supplementary European Search Report and the European Search Opinion Dated Jul. 29, 2010 From the European Patent Office Re. Application No. 08776651.5.

Supplementary European Search Report Dated Apr. 23, 2008 From the European Patent Office Re.: Application No. 05750089.4.

Supplementary European Search Report Dated Oct. 31, 2007 From the European Patent Office Re.: Application No. 04734072.4.

Supplementary Partial European Search Report Dated Aug. 30, 2007 From the European Patent Office Re.: Application No. 04734072.4.

Translation of Decision of Rejection Dated Dec. 9, 2011 From the State Intellectual Property Office of the People's Republic of China Re.: Application No. 200580027481.4.

Translation of Notice of Payment of the Restoration Fee for Unity of Invention Dated Mar. 20, 2009 From the State Intellectual Property Office of the People's Republic of China Re.: Application No. 200580027481.4.

Translation of Notification of the Office Action Dated Dec. 1, 2011 From the State Intellectual Property Office of the People's Republic of China Re. Application No. 200680047610.0.

Translation of Notification of the Office Action Dated Jun. 30, 2011 From the State Intellectual Property Office of the People's Republic of China Re. Application No. 200680047610.0.

Translation of Office Action Dated Jul. 1, 2011 From the State Intellectual Property Office of the People's Republic of China Re. Application No. 200880017707.6.

Translation of Office Action Dated Jan. 4, 2012 From the State Intellectual Property Office of the People's Republic of China Re. Application No. 200880109464.9.

Translation of Office Action Dated Apr. 9, 2012 From the State Intellectual Property Office of the People's Republic of China Re. Application No. 200880017707.6.

Translation of Office Action Dated Sep. 13, 2012 From the State Intellectual Property Office of the People's Republic of China Re. Application No. 200910217137.1.

Translation of Office Action Dated Jan. 17, 2012 From the State Intellectual Property Office of the People's Republic of China Re. Application No. 201110104274.1.

Translation of Office Action Dated Oct. 19, 2010 From the State Intellectual Property Office of the People's Republic of China Re. Application No. 200680038391.X.

(56) References Cited

OTHER PUBLICATIONS

Translation of Office Action Dated Jun. 22, 2011 From the State Intellectual Property Office of the People's Republic of China Re. Application No. 200880127685.9.
Translation of Office Action Dated Dec. 31, 2011 From the State Intellectual Property Office of the People's Republic of China Re. Application No. 200910217137.1.
Translation of the Office Action Dated Jan. 9, 2009 From the State Intellectual Property Office Re.: Application No. 2004800200597.0.
Written Opinion Dated Jul. 2, 2009 From the International Searching Authority Re.: Application No. PCT/IL07/01590.
Written Opinion Dated Jan. 3, 2007 From the International Searching Authority Re.: Application No. PCT/IL2005/000627.
Written Opinion Dated Mar. 4, 2009 From the International Searching Authority Re. : Application No. PCT/IL08/01024.
Written Opinion Dated Nov. 4, 2005 From the International Searching Authority Re.: Application No. PCT/Il04/00431.
Written Opinion Dated Aug. 27, 2008 From the International Searching Authority Re.: Application No. PCT/IL06/00947.
Adachi et al. "*Oryza sativa* Japonica Group cDNA Clone:J023021L06, Full Insert Sequence", Database EMBASE [Online], XP002665608, Retrieved From EBI, Database Accession No. AK099270, Jul. 19, 2003.
Aharon et al. "Overexpression of a Plasma Membrane Aquaporin in Transgenic Tobacco Improves Plant Vigor Under Favorable Growth Conditions but Not Under Drought or Salt Stress", The Plant Cell, 15: 439-447, Feb. 2003.
Alcala et at "Generation of ESTs From Tomato Fruit Tissue", Database GenBank on STIC, National Center for Biotechnology Information, Accession No. AW932839, 2001.
Apse et al. "Engineering Salt Tolerance in Plants", Current Opinion in Biotechnology, 13: 146-150, 2002.
Apse et al. "Engineering Salt Tolerance in Plants", Current Opinion in Biotechnology, XP003018468, 13(2): 146-150, Apr. 1, 2002.
Bernhardt et al. "The bHLH Genes GLABRA3 (GL3) and Enhancer of GLABRA3 (EGL3) Specify Epidermal Cell Fate in the *Arabidopsis* Root", Development, 130(26): 6431-6439, 2003.
Blast "BLAST Results", 1 P.
Blewitt et al. "BNLGHi10083 Six-Day Cotton Fiber *Gossypium hirsutum* cDNA 5' Similar to (AC004521) Unknown Protein [*Arabidopsis thaliana*], mRNA Sequence", XP002576188, Retrieved Fron EBI Accession No. EMBL:AI728187, Database Accession No. AI728187, Jun. 12, 1999. Sequence.
Blewitt et al. "BNLGHi8081 Six-Day Cotton Fiber *Gossypium hirsutum* cDNA 5' Similar to (AC004521) Unknown Protein [*Arabidopsis thalian*], mRNA Sequence", XP002576189, Retrieved From EBI Accesion No. EMBL:AI730835, Database Accession No. AI730835, Jun. 12, 1999. Sequence.
Blewitt et al. "BNLGHi8396 Six-Day Cotton Fiber *Gossypium hirsutum* cDNA 5' Similar to (AC004521) Unknown Protein [*Arabidopsis thaliana*], mRNA Sequence", XP002576190, Retrieved From EBI Accession No. EMBL:AI27553, Database Accession No. AI27553, Jun. 12, 1999. Sequence.
Blewitt et al. "*Gossypium hirsutum* Strain Acala Maxxa BURP Domain-Containing Protein (BNL1924) mRNA, Complete CDS", GenBank Nucleotide, GenBank Accession No. AY343972, Aug. 16, 2003.
Bowie et al. "Deciphering the Message in Protein Sequences: Tolerance to Amino Acid Substitutions", Science, 247(4948): 1306-1310, Mar. 16, 1990.
Brandle et al. "Perspectives on the Production of Recombinant Proteins in Plants", AgBiotechNet, 3(ABN 070): 1-4, 2001. Abstract.
Cheuk et al. "*Arabidopsis thaliana* At2g46960/F14M4.21 mRNA, Complete CDS", Database EMBL [Online], XP002593835, Retrieved From EBI Accession No. EMBL:AY091688, Database Accession No. AY091688, Apr. 14, 2002.
Daniell et al. "*Solanum bulbocastanum* Chloroplast, Complete Genome", GenBank NCBI, Accession No. NC 007943, Mar. 26, 2010. p. 1, Source, p. 10-11, Nucleotides 46590-47195, Gene 'RPS4'.

Davletova et al. "The Zinc-Finger Protein Zat12 Plays a Central Role in Reactive Oxygen and Abiotic Stress Signaling in *Arabidopsis*", Plant Physiology, 139: 847-856, Oct. 2005.
Feng et al. "Probable Cinnamyl Alcohol Dehydrogenase 6", Darabase UniProt [Online], XP002665609, Retrieved From EBI, Database Accession No. Q7XWU3, Mar. 1, 2004.
Francois et al. "Overexpression of the VvLTP1 Gene Interferes With Somatic Embryo Development in Grapevine", Functional Plant Biology, 35(5): 394-402, 2008.
Fray et al. "Nucleotide Sequence and Expression of a Ripening and Water Stress-Related cDNA From Tomato With Homology to the MIP Class of Membrane Channel Proteins", Plant Molecular Biology, XP009117320, 24(3): 539-543, 1994. Figs.1, 2. & Database UniProt, REcName: Full=Probable Aquaporin PIP-Type pTOM75; AltName: Full=Ripening-Associated Membrane Protein; Short=RAMP, Oct. 1, 1994.
Friedberg "Automated Protein Function Prediction—The Genomic Challenge", Briefings in Bioinformatics, 7(3): 225-242, 2006.
Gardiner et al. "*Zea mays* PCO131392 mRNA Sequence", Database EMBL/GenBank/DDBJ, EBI Database Accession No. AY107021, XP002542347, May 28, 2002. 96,5% Identity in 1118 nt Overlap of AY107021 (1118 nt) With Seq Id No. 68 (1348 nt) of the Present Application, Abstract.
Gaxiola et al. "Drought- and Salt-Tolerant Plants Result From Overexpression of the AVP1 H+-Pump", Proc. Natl. Acad. Sci. USA, PNAS, 98(20): 11444-11449, Sep. 25, 2001.
Gowik et al. "cis-Regulatory Elements for Mesophyll-Specific Gene Expression in the C4 Plant *Flaveria trinervia*, the Promoter of the C4 Phosphoenolpyruvate Carboxylase Gene", The Plant Cell, 16: 1077-1090, 2004.
Grover et al. "Understanding Molecular Alphabets of the Plant Abiotic Stress Responses", Current Science, 80(2): 206-216, Jan. 25, 2001.
Guo et al. "Protein Tolerance to Random Amino Acid Change", Proc. Natl. Acad. Sci. USA, PNAS, 101(25): 9205-9210, 2004.
Hachez et al. "Modulating the Expression of Aquaporin Genes in Planta: a Key to Understand Their Physiological Functions?", Biochimica et Biophysica Acta, XP005655605, 1758(8): 1142-1156, Aug. 1, 2006. p. 1151, col. 1, § 2-p. 1153, col. 1, § 1, Table 1.
Hattori et al. "An Acetohydroxy Acid Synthase Mutant Reveals a Single Site Involved in Multiple Herbicide Resistance", Molecular and General Genetics, 246: 419-425, 1995. Abstract.
Hill et al. "Functional Analysis of Conserved Histidines in ADP-Glucose Pyrophosphorylase From *Escherichia coli*", Biochemical and Biophysical Research Communications, 244(2): 573-577, 1998.
Holmstroem et al. "Drought Tolerance in Tobacco", Nature, 379: 683-684, 1996. Abstract.
In et al. "Panax Gingseng mRNA for Cytoplasmic Ribosomal Protein S13, Complete Cds", Database EMBL [Online], Retrieved From EBI Accession No. EMBL, Database Accession No. AB043974, 2000.
Invitrogen "SuperScript® Plasmid System With Gateway® Technology for cDNA Synthesis and Cloning", Invitrogen by Life Technologies, User Manual, Catalog No. 18248-013, Manual Part No. 11108, 44 P., Dec. 22, 2010.
Ishikawa et al. JP 2005-185101: Full Length cDNA of Plant and the Use Thereof', Database EMBL [Online], XP002678022, Retrieved From EBI Accession No. EM_PAT:HV067703, Database Accession No. HV067703, Jul. 15, 2011. Sequence.
Ji et al. "*Gossypium hirsutum* Expansin mRNA, Complete CDs", Database EMBL [Online], XP002474936, Retrieved From EBI Accession No. EMBL:AY189969, Database Accession No. AY189969, May 20, 2003.
Ji et al. "Isolation and Analyses of Genes Preferentially Expressed During Early Cotton Fiber Development by Subtractive PCR and cDNA Array", Nucleic Acids Research, XP002474935, 31(10): 2534-2543, May 15, 2003.
Johansson et al. "The Role of Aquaporins in Cellular and Whole Plant Water Balance," Biochimica et Biophysica Acta 1465: 324-342, 2000.
Kandel et al. "Cloning, Functional Expression, and Characterization of CYP709C1, the First Sub-Terminal Hydroxylase of Long Chain Fatty Acid in Plants", Journal of Biological Chemistry, JBC, 280(43): 35881-35889, Oct. 28, 2005. p. 35887, col. 1, Para 2.

(56) References Cited

OTHER PUBLICATIONS

Kano-Murakami et al. "A Rice Homeotic Gene, OSH1, Causes Unusual Phenotypes in Transgenic Tobacco", FEBS Letters, 334(3): 365-368, Nov. 1993.
Katavic et al. "Utility of the *Arabidopsis* FAE1 and Yeast SLC1-1 Genes for Improvement in Erucic Acid and Oil Content in Rapeseed", Biochemical Society Transactions, 28(6): 935-937, Dec. 2000.
Katavic et al. "Utility of the *Arabidopsis* FAE1 and Yeast SLC1-1 Genes for Improvements in Erucic Acid and Oil Content in Rapeseed", Biochemical Society Transactions, 28: 935-7, 2000. Abstract.
Keskin et al. "A New, Structurally Nonredundant, Diverse Data Set of Protein—Protein Interfaces and its Implications", Protein Science, 13: 1043-1055, 2004.
Kikuchi et al. "Rice cDNA-Encoded Protein Seq Id No. 31047", Database Geneseq [Online], XP002678021, Retrieved From EBI Accession No. GSP:AQD37188, Database Accession No. AGD37188, Jun. 12, 2008. Shows 100% Identity to Present Seg Id No:246 (Protein) and Corresponding Polynucleotide Shows 100 % Identity to Seq Id No:7 Over 458 Nucleotides. Abstract.
Kim et al. "*Arabidopsis thaliana* At2g46960/F14M4.21 mRNA, Complete CDS", Database EMBL [Online], XP002593834, Retrieved From EBI Accession No. EMBL:AF367329, Database Accession No. AF367329, Apr. 12, 001.
Kim et al. "Molecular Cloning of Low-Temperature-Inducible Ribosomal Proteins From Soybean", Journal of Experimental Botany, 55(399): 1153-1155, 2004.
Kirkness et al. "*Lycopersicon esculentum* Clone 133453R, mRNA Sequence", Database EMBL [Online], XP002529190, Retrieved From EBI Accession No. EMBL:BT014251, Database Accession No. BT014251, May 12, 2004.
Kirubakaran et al. "Characterization of a New Antifungal Lipid Transfer Protein From Wheat", Plant Physiology and Biochemistry, 46: 918-927, 2008.
La Rosa et al. "*Oryza sativa* Amino Acid Sequence Seq Id No. 133688", Database Geneseq [Online], XP002678023, Retrieved From EBI Accession No. GSP:ANM19687, Database Accession No. ANM19687, Dec. 28, 2007. 100% Identity to Present Seq Ifd No. 246, Corresponding Polynucleotide Has 99,6% Identity to Present Seq Id No. 7 Over 488 Nucleotides. Abstract, Sequence.
La Rosa et al. "*Oryza sativa* Nucleotide Sequence Seq Id No. 31205", Database Geneseq [Online], XO002678024, Retrieved From EBI Accession No. GSN:ANL17203, Database Accession No. ANL17203, Dec. 28, 2007. Sequence.
Li et al. "*Gossypium hirsutum* Dehydration-Induced Protein RD22-Like Protein (RDL) mRNA, Complete CDS", EBI Accession No. EMBL:AY072821, XP002639385, Database Accession No. AY072821, Dec. 4, 2002. Compound.
Li et al. "Isolation of Genes Preferntially Expressed in Cotton Fibers by cDNA Filter Arrays and RT-PCR", Plant Science, XP002639386, 163(6): 1113-1120, 2002.
Lin et al. "*Arabidopsis thaliana* Chromosome III BAC F7O18 Genomic Sequence, Complete Sequence", GenBank Accession No. AC011437, Oct. 30, 2002.
Liu et al. "Root-Specific Expression of a Western White Pine PR10 Gene is Mediated by Different Promoter Regions in Transgenic Tobacco", Plant Molecular Biology, 52: 103-120, 2003.
Matsumoto et al. "*Hordeum vulgare* Subsp. *vulgare*, Full-Length cDNA", UniProtKB/TrEMBL, Id: F2DLE8-HORVD, UniProt Accession No. F2DLE8, May 31, 2011.
Maurel "Plant Aquaporins: Novel Functions and Regulation Properties", FEBS Letters, XP022078418, 581(12): 2227-2236, May 25, 2007. p. 2230, col. 2, Last § -p. 2231, col. 1, § 2, Fig. 1.
McConnell et al. "Role of *Phabulosa* and *Phavoluta* in Determining Radial Patterning in Shoots", Nature, 411(6338): 709-713, Jun. 7, 2001.
Merriam-Webster "Exogenous Definition", Merrian-Webster On-Line Dictionary, 2010.

NCBI "Protein Sequence (588 Letters)", NCBI BLAST Basic Local Alignment Search Tool, 3 P., Retrieved From the Internet on Nov. 24, 2009.
Ngo et at "Computational Complexity, Protein Structure Prediction, and the Levinthal Paradox", The Protein Folding Problem and Tertiary Structure Prediction, p. 433, 492-495, 1994.
Nuccio et al. "Metabolic Engineering of Plants for Osmotic Stress Resistance", Current Opinion in Plant Biology, XP002216348, 2(2): 128-134, Apr. 1, 1999.
Orford et al. "Specific Expression of an Expansin Gene During Elongation of Cotton Fibres", Biochimica et Biophysica Acta, XP000866032, 1398(3): 342-346, Jul. 9, 1998. Abstract, p. 343, Fig. 1.
Orzaez et al. "Agroinjection of Tomato Fruits. A Tool for Rapid Functional Analysis of Transgenes Directly in Fruit", Plant Physiology, 140: 3-11, 2006.
Park et al. "Glycine Max Ribosomal Protein S13 (RPS13) mRNA, Complete Cds", Database EMBL [Online], Retreieved From EBI Accession No. EMBL, Database Accession No. AY453393, 2004.
Payne et al. "GL3 Encodes a bHLH Protein That Regulates Trichome Development in *Arabidopsis* Through Interaction With GL1 and TTG1", Genetics, 156: 1349-1362, Nov. 2000.
Payne et al. "Heterologous MYB Genes Distinct From GL1 Enhance Trichome Production When Overexpressed in *Nicotiana tabacum*", Development, 126: 671-682, 1999.
Pilon-Smits et al. "Improved Performance of Transgenic Fructan-Accumulating Tobacco under Drought Stress", Plant Physiology, 107: 125-130, 1995.
Purnelle et al. "*Arabidopsis thaliana* DNA Chromosome 3, BAC Clone F3C22", Database EMBL [Online], XP002640829, Retrieved From EBI Accession No. EMBL:AL353912, Database Accession No. AL 353912, Apr. 27, 2000. Compound.
Quesada et al. "Genetic Architecture of NaC1 Tolerance in *Arabidopsis*", Plant Physiology, 130: 951-963, 2002. Abstract.
Saez-Vasquez et al. "Accumulation and Nuclear Targeting of BnC24, a *Brassica napus* Ribosomal Protein Corresponding to a mRNA Accumulating in Response to Cold Treatment", Plant Science, 156(1): 35-46, 2000.
Saijo et al. "Over-Expression of a Single Ca 2+-Dependent Protein Kinase Confers Both Cold and Salt/Drought Tolerance on Rice Plants", The Plant Journal 23(3): 319-327, 2000.
Skriver et al. "Cis-Acting DNA Elements Responsive to Gibberellin and its Antagonist Abscisic Acid", Proceedings of the National Academy of Sciences USA 88: 7266-7270, 1991.
Smart et al. "MIP Genes are Down-Regulated Under Drought Stress in *Nicotiana glauca*", Plant and Cell Physiology, XP002455682, 42(7): 686-693, 2001. p. 686, Reference to Database Entry AF290618, p. 692, l-h col., § 2.
Smart et al. "*Nicotiana glauca* Putative Delta TIP (MIP2) mRNA, Complete Cds", Database EMBL [Online], Retrieved From EBI Accession No. EMBL: AF290618, XP002455682, Database Accession No. AF290618, Jan. 2, 2001.
Sunkar et al. "Small RNAs as Big Players in Plant Abiotic Stress Responses and Nutrient Deprivation", Trends in Plant Science, XP022148764, 12(7): 301-309, Jul. 1 2007.
Taliercio et al. "GH_TMIRS_129_G10_F Cooton Normalized Library dT Primed *Gossypium hirsutum* cDNA, mRNA Sequence", EMBL-Bank, XP002659970, Retrieved From EBI Accession No. EM_EST:DW508992, Database Accession No. DW508992.
Taliercio et al. "GH_TMIRS_129_G10_R Cotton Normalized Library dT Primed *Gossypium hirsutum* cDNA, mRNA Sequence", EMBL-Bank, XP002659971, Retrieved From EBI Accession No. EM_EST:DW508993, Database Accession No. DW508993.
Tamura et al. "Osmotic Stress Tolerance of Transgenic Tobacco Expressing a Gene Encoding a Membrane-Located Receptor-Like Protein From Tobacco Plants", Plant Physiology, 131(2): 454-462, 2003.
Tanaka et al. "Enhanced Tolerance Against Salt-Stress and Freezing-Stress of *Escherichia coli* Cells Expressing Algal BBC1 Gene", Current Microbiology, 42(3): 173-177, 2001.
Tarczynski et al. "Stress Protection of Transgenic Tobacco by Production of the Osmolyte Mannitol", Science, 259: 508-510, 1993. Abstract.

(56) References Cited

OTHER PUBLICATIONS

Thornton et al. "From Structure to Function: Approaches and Limitations", Nature Structural Biology. Structural Genomic Supplement, Nov. 2000, p. 991-994.
Udall et al. "A Global Assembly of Cotton ESTs", Genome Research, 16(3): 441-450, 2006.
Van der Hoeven et al. "EST301294 Tomato Root During/After Fruit Set, Cornell University *Lycopersicon esculentum* cDNA Clone cLEX1K11 Similar to *Vernicia fordii* Aquaporin, mRNA Sequence", Database EMBL [Online], Retrieved From EMBI Accession No. EMBL: AW218814, XP002455680, Database Accession No. AW218814, Dec. 14, 1999. Abstract.
Van der Hoeven et al. "EST301295 Tomato Root During/After Fruit Set, Cornell University *Lycopersicon esculentum* cDNA Clone cLEX1K11 Similar to *Vernicia fordii* Aquaporin, mRNA Sequence", Database EMBL [Online], Retrieved From EBI Accession No. EMBL: AW218815, XP002455681, Database Accession No. AW218815, Dec. 14, 1999. Abstract.
Van der Hoeven et al. "EST312975 Tomato Root During/After Fruit Set, Cornell University *Solanum lycopersicum* cDNA Clone cLEX14O20 5-, mRNA Sequence", GenBank, GenBank Accession No. AW622177.1.
Van der Hoeven et al. "EST428934 Tomato Nutrient Deficient Roots *Lycopersicon esculentum* cDNA Clone cLEW26B2 5' Sequence, mRNA Sequence", Database EMBL, Retrieved From EBI Accession No. EMBL, Database Accession No. BF098413, 2000.
Van Haaren et al. "A Functional Map of the Fruit-Specific Promoter of the Tomato 2A11 Gene", Plant Molecular Biology, 21: 625-640, 1993. Abstract.
Vigeolas et al. "Increasing Seed Oil Content in Oil-Seed Rape (*Brassica napus* L.) by Over-Expression of a Yeast Glycerol-3-Phosphate Dehydrogenase Under the Control of a Seed-Specific Promoter", Plant Biotechnology Journal, 5 Issue: 431-441, 2007. Abstract.
Wallace et al. "Oligonucleotide Probes for the Screening of Recombinant DNA Libraries", Methods in Enzymology, XP002957829, 152: 432-442, Jan. 1, 1987.
Wang et al. "Control of Plant Trichome Development by a Cotton Fiber MYB Gene", The Plant Cell, 16: 2323-2334, Sep. 2004.
Wang et al. "Control of Plant Trichome Development by a Cotton Fiber MYB Gene", The Plant Cell, 16: 2323-2334, Sep. 2004. GenEmbl Database, Accession No. AY641990.
Wang et al. "The Soybean Dof-Type Transcription Factor Genes, GmDof4 and GmDof11, Enhance Lipid Content in the Seeds of Transgenic *Arabidopsis* Plants", The Plant Journal, 52: 716-729, 2007. Abstract.
Wells "Additivity of Mutational Effects in Proteins", Biochemistry, 29 (37): 8509-8517, 1990.
Whisstock et al. "Prediction of Protein Function from Protein Sequence and Structure," Quarterly Reviews of Biophysics 36 (3): 307-340, Aug. 2003.
Wing et al. "An Integrated Analysis of the Genetics, Devlopment, and Evolution of Cotton Fiber", NBCI GenBank Accession No. BE052336, 2000.
Wing et al. "GA_Eb0023F09f *Gossypium arboreum* 7-10 Dpa Fiber Library *Gossypium arboreum* cDNA Clone GA_Eb0023F09f, mRNA Sequence", XP002576191, Retrieved From EBI Accession No. EMBL:BF275177, Database Accession No. BF275177, Nov. 20, 2000. Sequence.
Wing et al. "GA_Eb0026P18f *Gossypium arboreum* 7-10 Dpa Fiber Library *Gossypium arboreum* cDNA Clone GA_Eb0026P18f, mRNA Sequence", Database Embl [Online], XP002640830, Retrieved From EBI Accession No. EMBL:BF277249, Database Accession No. BF277249, Nov. 20, 2000.
Wu et al. "SubName: Full=Major Intrinsic Protein", Database UniProt [Online], XP002529191, Retrieved From Accession No. UniProt:AOFI89, Database Accession No. AOFI89, Nov. 28, 2006.
Xu et al. "Expression of a Late Embryogenesis Abundant Protein Gene, HVA1 From Barley Confers Tolerance to Water Deficit and Salt Stress in Transgenic Rice", Plant Physiology, 110: 249-257, 1996.

Yamada et al. "*Arabidopsis thaliana* Clone RAFL14-87-A16 (R20399) Unknown Protein (At1g60770) mRNA Complete Cds", GenBank Accession No. BT002876, Retrieved From the Internet, Jan. 21, 2010.
Yamada et al. "*Arabidopsis thaliana* Unknown Proein (At3g51610) mRNA, Complete CDS", Database EMBL [Online], XP002640828, Retrieved Fom EBI Accession No. EMBL:AY034915, Database Accession No. AY034915, Jun. 13, 2001. Compound.
Yanagisawa et al. "Diversity and Similarity Among Recognition Sequences of Dof Transcription Factors", The Plant Journal, 17(2): 209-214, 1999.
Yanagisawa et al. "Metabolic Engineering With Dof1 Transcription Factor in Plants: Improved Nitrogen Assimilation and Growth Under Low-Nitrogen Conditions", Proc. Natl. Acad. Sci. USA, PNAS, 101(20): 7833-7838, May 18, 2004.
Yanagisawa et al. "Metabolic Engineering With Dof1 Transcription Factor in Plants: Improved Nitrogen Assimilation and Growth Under Low-Nitrogen Conditions", Proc. Natl. Acad. Sci. USA PNAS, 101(20): 7833-7838, May 18, 2004.
Zabrouskov et al. "Oxidative Metabolism and the Physiological Age of Seed Potatoes are Affected by Increased Alpha-Linolenate Content", Physiologia Plantarum, 116: 172-185, 2002.
Restriction Official Action Dated Nov. 13, 2012 From the US Patent and Trademark Office Re. U.S. Appl. No. 12/992,902.
Backhaus et al. "Nucleotide Sequence of a cDNA for a P2 60S Acidic Ribosomal Protein From *Parthenium argentatum*", Plant Physiology, 106: 395, 1994.
Del Pozo et al. "F-Box Proteins and Protein Degradation: A Emerging Theme in Cellular Regulation", Plant Molecular Biology, 44(2): 123-128, Sep. 2000.
Harwood "Plant Fatty Acid Synthesis", The AOCS Lipid Library, 11 P., Apr. 12, 2010.
Communication Under Rule 71(3) EPC Dated Nov. 19, 2012 From the European Patent Office Re. Application No. 08738191.9.
Notice of Allowance Dated Jan. 7, 2013 From the US Patent and Trademark Office Re. U.S. Appl. No. 12/457,199.
Official Action Dated Jan. 18, 2013 From the US Patent and Trademark Office Re. U.S. Appl. No. 12/669,975.
Translation of Notice to Amendment Dated Aug. 31, 2012 From the Thai Patent Office, Department of Intellectual Property Office Re. Application No. 0901000235.
Examination Report Dated Dec. 7, 2012 From the Instituto Mexicano de la Propiedad Industrial Re. Application No. MX/a/2011/003575 and its Translation Into English.
Patent Examination Report Dated Jan. 4, 2013 From the Australian Government, IP Australia Re. Application No. 2008344935.
Translation of Office Action Dated Jan. 17, 2013 From the State Intellectual Property Office of the People's Republic of China Re. Application No. 201110104274.1.
Translation of Search Report Dated Jan. 17, 2013 From the State Intellectual Property Office of the People's Republic of China Re. Application No. 201110104274.1.
International Preliminary Report on Patentability Dated Feb. 21, 2013 From the International Bureau of WIPO Re. Application No. PCT/IB2011/051843.
Official Action Dated Feb. 8, 2013 From the US Patent and Trademark Office Re. U.S. Appl. No. 12/594,853.
Supplementary European Search Report and the European Search Opinion Dated Feb. 14, 2013 From the European Patent Office Re. Application No. 10785834.2.
Translation of Office Action Dated Feb. 25, 2013 From the State Intellectual Property Office of the People's Republic of China Re. Application No. 200910217137.1.
Communication Pursuant to Rules 70(2) and 70a(2) EPC Dated Mar. 5, 2013 From the European Patent Office Re. Application No. 10785834.2.
Requisition by the Examiner Dated Feb. 12, 2013 From the Canadian Intellectual Property Office Re. Application No. 2,570,195.
International Preliminary Report on Patentability Dated Mar. 14, 2013 From the International Bureau of WIPO Re. Application No. PCT/IB2011/053697.
Notice of Allowance Dated Apr. 8, 2013 From the US Patent and Trademark Office Re. U.S. Appl. No. 12/594,853.

(56) References Cited

OTHER PUBLICATIONS

Requisition by the Examiner Dated Mar. 25, 2013 From the Canadian Intellectual Property Office Re. Application No. 2,619,114.
Invitation to Pay Additional Fees Dated Oct. 17, 2012 From the International Searching Authority Re. Application No. PCT/IL2012/050154.
International Search Report and the Written Opinion Dated Apr. 10, 2013 From the International Searching Authority Re. Application No. PCT/IL2012/050327.
Invitation to Pay Additional Fees Dated Apr. 8, 2013 From the International Searching Authority Re. Application No. PCT/IL2013/050172.
Requisition by the Examiner Dated Apr. 11, 2013 From the Canadian Intellectual Property Office Re. Application No. 2,626,592.
Translation of Office Action Dated Mar. 22, 2013 From the State Intellectual Property Office of the People's Republic of China Re. Application No. 200880109464.9.
Soderlund et al. "Sequencing, Mapping, and Analysis of 27,455 Maize Full-Length cDNAs", PLoS Genetics, 5(11): e1000740-1-e1000740-13, Nov. 2009.
Restriction Official Action Dated Mar. 1, 2013 From the US Patent and Trademark Office Re. U.S. Appl. No. 13/254,183.
Office Action Dated Apr. 1, 2013 From the State Intellectual Property Office of the People's Republic of China Re. Application No. 200880127757.X and its Translation Into English.
Communication Pursuant to Article 94(3) EPC Dated May 29, 2013 From the European Patent Office Re. Application No. 09823171.5.
Official Action Dated Jun. 24, 2013 From the US Patent and Trademark Office Re. U.S. Appl. No. 12/992,902.
Patent Examination Report Dated Jun. 21, 2013 From the Australian Government, IP Australia Re. Application No. 2012241091.
Arabidopsis Genome Initiative "Analysis of the Genome Sequence of the Flowering Plant *Arabidopsis thaliana*" Nature, 408: 796-815, Dec. 14, 2000.
Ciddi et al. "Elicitation of Taxus SP. Cell Cultures for Production of Taxol", Biotechnology Letters, 17(12): 1343-1346, Dec. 1995.
Kikuchi et al. "*Oryza sativa* Japonica Group cDNA Clone:J023131O04, Full Insert Sequence", GenRank Database Accession No. AK072531, Jul. 2, 2013.
Lurin et al. "Genome-Wide Analysis of *Arabidopsis* Pentatricopeptide Repeat Proteins Reveals Their Essential Role in Organelle Biogenesis", The plant Cell, 16: 2089-2103, Aug. 2004.
Terminology "Frequently Asked Questions", Bioinformatics Website, Frequently Asked Questions, 2001.
Theologis et al. "Sequence and Analysis off Chromosome 1 of the Plant *Arabidopsis thaliana* ", Nature, 408: 816-820, Dec. 14, 2000.
Examination Report Dated May 23, 2013 From the Instituto Mexican de la Propiedad Industrial Re. Application No. MX/a/2011/001741 and its Translation Into English.
Invitation to Pay Additional Fees Dated Jul. 17, 2013 From the International Searching Authority Re. Application No. PCT/IB2013/054374.
Official Action Dated Jul. 26, 2013 From the US Patent and Trademark Office Re. U.S. Appl. No. 13/254,183.
Matsumoto et al. "Os11g0162200 [*Oryza sativa* Japonica Group]", Direct GenBank Sequence Submission, GenBank: BAF27672.1, GenBank Accession No. BAF27672, Aug. 11, 2012.
Communication Pursuant to Article 94(3) EPC Dated May 8, 2013 From the European Patent Office Re. Application No. 08776651.5.
Official Action Dated May 20, 2013 From the US Patent and Trademark Office Re. U.S. Appl. No. 13/059,231.
Patent Examination Report Dated May 31, 2013 From the Australian Government, IP Australia Re. Application No. 2008278654.
Hirner et al. "*Arabidopsis* LHT1 is a High-Affinity Transporter for Cellular Amino Acid Uptake in Both Root Epidermis and Leaf Mesophyll", The Plant Cell, 18: 1931-1946, Aug. 2006.
Plant Energy Biology "Protein_Coding: Cationic Amino Acid Transporter 2 (TAIR10)", Plant Energy Biology: SUBA3 Flatfile for AT1G58030.1, Database, 1 P., 2007.
Rolletschek et al. "Ectopic Expression of an Amino Acid Transporter (VfAAP1) in Seeds of *Vica narbonensis* and Pea Increases Storage Proteins", Plant Physiology, 137: 1236-1249, Apr. 2005.
Su et al. "Molecular and Functional Characterization of a Family of Amino Acid Transporter From *Arabidopsis*", Plant Physiology, 136: 3104-3113, Oct. 2004.
TAIR "Encodes a Member of the Cationic Amino Acid Transporter (CAT) Subfamily of Amino Acid Polyamine Choline Transporters. Localized to the Tonoplast", TAIR, Locus: AT1G58030, TAIR Accession No. Locus:2196245, 4 P., 2013.
TAIR "Protein Kinase Superfamily Protein. Functions in: Protein Serine/Threonine Kinase Activity, Protein Kinase activity, Kinase Activity, ATP Binding ff.", TAIR, Locus: AT5G15080, TAIR Accession No. Locus:2147805, 4 P., 2013.
Patent Examination Report Dated Jun. 27, 2013 From the Australian Government, IP Australia Re. Application No. 2012216482.
Matz et al. "*Gossypium hirsutum* GHDEL65 (ghde165) mRNA, Complete CDS", Gen Bank Nucleotide, GenBank Accession No. AF336280, Mar. 15, 2001.
Communication Pursuant to Article 94(3) EPC Dated Aug. 2, 2013 From the European Patent Office Re. Application No. 10194223.3.
Examination Report Dated Jul. 9, 2013 From the Instituto Mexicano de la Propiedad Industrial Re. Application No. MX/a/2010/007169 and its Translation Into English.
Examination Report Dated Jun. 26, 2013 From the Instituto Mexicano de la Propiedad Industrial Re. Application No. MX/a/2010/000975 and its Translation Into English.
Official Action Dated Aug. 12, 2013 From the US Patent and Trademark Office Re. U.S. Appl. No. 12/834,106.
Substantive Examination Report Dated Jul. 31, 2013 From the Intellectual Property Office of the Philippines, Bureau of Patents Re. Application No. 1/2009/501930.
International Search Report and the Written Opinion Dated May 12, 2013 From the International Searching Authority Re. Application No. PCT/IL2013/050172.
Desveaux et al. "Whirly Transcription Factors: Defense Gene Regulation and Beyond", Trends in Plant Science, TiPS, 10(2): 95-102, Feb. 2005.
Young et al. "Hypothetical Protein MTR_7g116270 [*Medicago truncatula*]", Database NCBI [Online], GenBank: AES82688.1, Database Accession No. AES82688, Nov. 21, 2011.
Examination Report Dated Mar. 23, 2013 From the Government of India, Patent Office, Intellectual Property Building Re. Application No. 2570/CHENP/2008.
International Preliminary Report on Patentability Dated Jul. 4, 2013 From the International Bureau of WIPO Re. Application No. PCT/IB2011/055854.
Communication Pursuant to Article 94(3) EPC Dated Nov. 7, 2013 From the European Patent Office Re. Application No. 10748403.2.
Communication Pursuant to Rules 70(2) and 70a(2) EPC Dated Nov. 4, 2013 From the European Patent Office Re. Application No. 10840687.7.
Examination Report Dated Aug. 22, 2013 From the Instituto Mexican de la Propicdad Industrial Re. Application No. MX/a/2011/009044 and its Translation Into English.
Official Action Dated Oct. 29, 2013 From the US Patent and Trademark Office Re. U.S. Appl. No. 13/059,231.
Seki et al. "Monitoring the Expression Profiles of 7000 *Arabidopsis* Genes Under Drought, Cold and High-Salinity Stresses Using a Full-Length cDNA Microarray", The Plant Journal, 31(3): 279-292, 2002.
Tobias et al. "Structure of the Cinnamyl-Alcohol Dehydrogenase Gene Family in Rice and Promoter Activity of a Member Associated With Lignification", Planta, 220: 678-688, 2005.
Notice of Allowance Dated Nov. 15, 2013 From the US Patent and Trademark Office Re. U.S. Appl. No. 12/669,975.
Requisition by the Examiner Dated Aug. 27, 2013 From the Canadian Intellectual Property Office Re. Application No. 2,526,440.
Official Action Dated Jan. 9, 2014 From the US Patent and Trademark Office Re. U.S. Appl. No. 12/992,902.
Bork et al. "Go Hunting in Sequence Databases but Watch Out for the Traps", Trends in Genetics, TIG, 12(10): 425-427, Oct. 1996.

(56) References Cited

OTHER PUBLICATIONS

Doerks et al. "Protein Annotation: Detective Work for Function Prediction", Trends in Genetics, TIG, 14(6): 248-250, Jun. 1998.
Smith et al. "The Challenges of Genome Sequence Annotation or 'The Devil is in the Details'", Nature Biotechnology, 15: 1222-1223, Nov. 1997.
Communication Pursuant to Article 94(3) EPC Dated Oct. 9, 2013 From the European Patent Office Re. Application No. 08869158.9.
Communication Pursuant to Article 94(3) EPC Dated Aug. 20, 2013 From the European Patent Office Re. Application No. 11172514.9.
International Search Report and the Written Opinion Dated Sep. 1, 2013 From the International Searching Authority Re. Application No. PCT/IB2013/054374.
Invitation to Pay Additional Fees Dated Oct. 16, 2013 From the International Searching Authority Re. Application No. PCT/IL2013/050725.
Office Action Dated Sep. 9, 2013 From the State Intellectual Property Office of the People's Republic of China Re. Application No. 200910217137.1 and its Translation Into English.
Office Action Dated Oct. 28, 2013 From the State Intellectual Property Office of the People's Republic of China Re. Application No. 201110104274.1 and its Translation Into English.
Official Action Dated Sep. 20, 2013 From the US Patent and Trademark Office Re. U.S. Appl. No. 12/669,975.
Supplementary European Search Report and the European Search Opinion Dated Oct. 15, 2013 From the European Patent Office Re. Application No. 10840687.7.
Translation of Office Action Dated Aug. 28, 2013 From the State Intellectual Property Office of the People's Republic of China Re. Application No. 200880109464.9.
Bennetzen et al. "*Setaria italica* Strain Yugu 1 SETITScaffold_2_Cont751, Whole Genome Shotgun Sequence", Database NCBI [Online], GenBank Accession No. AGNK01000751, May 11, 2012.
Briggs et al. "Poly(ADP-Ribosyl)ation in Plants", Trends in Plant Science, 16(7): 372-380, Jul. 31, 2011. p. 378.
Liu et al. "Plant Full Length Insert Polypeptide Seqid 64542", Database Geneseq [Online], XP002713973, Retrieved From EBI Accession No. GSP:ADY08727, Database Accession No. ADY08727, Apr. 21, 2005. Polypeptide Has 96.4% Identity to Seq Id No:653 and is Used for the Same Purpose, Abstract, Sequence.
NCBI "Predicted: Nudix Hydrolase 16, Mitochondrial-Like [*Setaria italica*]", Database NCBI [Online], NCBI Reference Sequence: XP_004955808, Jun. 26, 2013.
Paterson et al. "*Sorghum bicolor* Chromosome 2, Whole Genome Shotgun Sequence", NCBI Database [Online], Retrieved From EBI Accession No. EMBL:CM000761, Database Accession No. CM000761, Jun. 24, 2009. Sequence.
Paterson et al. "SubName: Full=Putative Uncharacterized Protein Sb02g004350", Database UniProt [Online], XP002713972, Retrieved From EBI Accession No. UNIPROT:C5XB01, Database Accession No. C5XB01, Sep. 1, 2009. Polynucleotide and Polypeptide Molecules Fully Comprising the Present Molecules According to Seq Id No. 166, 653, Abstract, Sequence.
Communication Pursuant to Rule 58 EPC or Rule 159 EPC, Invitation to Remedy Deficiencies in the Application Documents Dated Dec. 6, 2013 From the European Patent Office Re. Application No. 11190921.4.
Patent Examination Report Dated Jan. 3, 2014 From the Australian Government, IP Australia Re. Application No. 2008278654.
Advisory Action Before the Filing of an Appeal Brief Dated Nov. 19, 2013 From the US Patent and Trademark Office Re. U.S. Appl. No. 12/834,106.
Advisory Action Before the Filing of an Appeal Brief Dated Dec. 20, 2013 From the US Patent and Trademark Office Re. U.S. Appl. No. 12/834,106.
Applicant-Initiated Interview Summary Dated Dec. 18, 2013 From the US Patent and Trademark Office Re. U.S. Appl. No. 12/834,106.
Examination Report Dated Oct. 1, 2013 From the Instituto Mexican de la Propiedad Industrial Re. Application No. MX/a/2010/000975 and its Translation Into English.
Examination Report Dated Dec. 16, 2013 From the Government of India, Patent Office, Intellectual Property Building Re. Application No. 2570/CHENP/2008.
International Preliminary Report on Patentability Dated Nov. 14, 2013 From the International Bureau of WIPO Re. Application No. PCT/IL2012/050154.
International Search Report and the Written Opinion Dated Nov. 19, 2013 From the International Searching Authority Re. Application No. PCT/IL2013/050725.
Requisition by the Examiner Dated Oct. 28, 2013 From the Canadian Intellectual Property Office Re. Application No. 2,570,195.
Lazar et al. "Transforming Growth Factor Alpha: Mutation of Aspartic Acid 47 and Leucine 48 Results in Different Biological Activities", Molecular and Cell Biology, 8(3): 1247-1252, Mar. 1988.
Li et al. "Dehydration-Induced Protein RD22-Like Protein [*Gossypium hirsutum*]", NCBI Database [Online], GenBank: AAL67991. 1, GenBank Accession No. AAL67991, Dec. 4, 2002.
Yu et al. "Cell Cycle Checkpoint Protein MAD2 Homolog [*Zea mays*]", Database NCBI [Online], GenBank: AAD30555.1, GenBank Accession No. AAD30555, May 17, 1999.
Communication Pursuant to Article 94(3) EPC Dated Jul. 28, 2014 From the European Patent Office Re. Application No. 09823171.5.

* cited by examiner

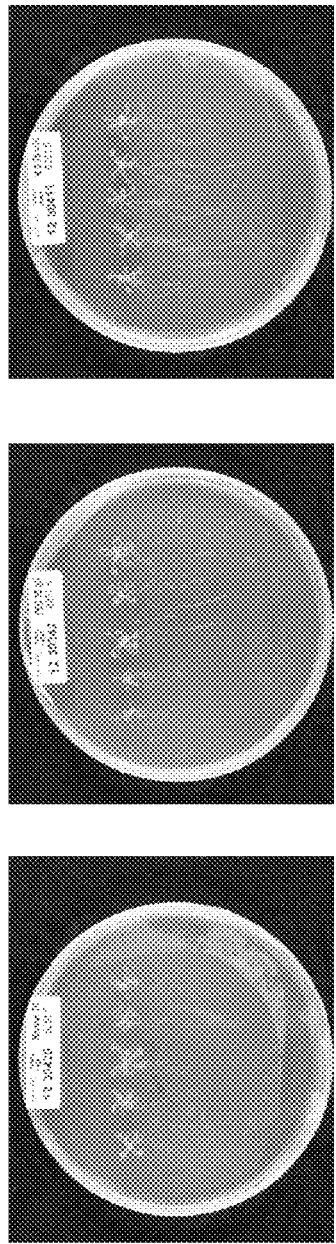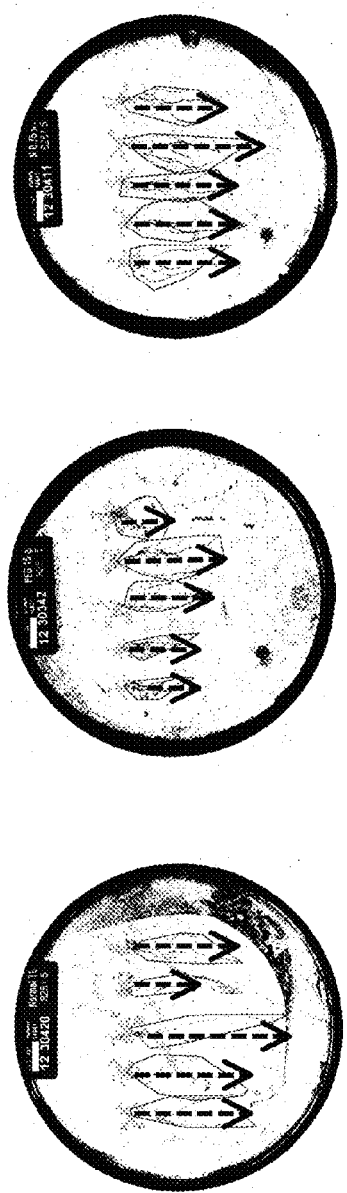
FIG. 3A  FIG. 3B  FIG. 3C  FIG. 3D  FIG. 3E  FIG. 3F
Normal conditions
Osmotic stress (15 % PEG)
Nitrogen limiting conditions

US 8,921,658 B2

ISOLATED POLYNUCLEOTIDES ENCODING A MAP65 POLYPEPTIDE AND METHODS OF USING SAME FOR INCREASING PLANT YIELD

RELATED APPLICATIONS

This application is a National Phase of PCT Patent Application No. PCT/IB2009/054774 having International filing date of Oct. 28, 2009, which claims the benefit of priority of U.S. Provisional Patent Application Nos. 61/187,683 filed on Jun. 17, 2009, and 61/193,141, filed on Oct. 30, 2008. The contents of the above applications are all incorporated herein by reference.

FIELD AND BACKGROUND OF THE INVENTION

The present invention, in some embodiments thereof, relates to polypeptides, polynucleotides encoding same, transgenic plants expressing same and methods of producing and using same, and, more particularly, but not exclusively, to methods of increasing plant yield, oil yield, seed yield, biomass, growth rate, vigor, oil content, abiotic stress tolerance and/or nitrogen use efficiency.

Abiotic stress conditions such as salinity, drought, flood, suboptimal temperature and toxic chemical pollution, cause substantial damage to agricultural plants. Most plants have evolved strategies to protect themselves against these conditions. However, if the severity and duration of the stress conditions are too great, the effects on plant development, growth and yield of most crop plants are profound. Furthermore, most of the crop plants are highly susceptible to abiotic stress (ABS) and thus necessitate optimal growth conditions for commercial crop yields. Continuous exposure to stress causes major alterations in the plant metabolism which ultimately leads to cell death and consequently yield losses.

The global shortage of water supply is one of the most severe agricultural problems affecting plant growth and crop yield and efforts are made to mitigate the harmful effects of desertificFation and salinization of the world's arable land. Thus, Agbiotech companies attempt to create new crop varieties which are tolerant to different abiotic stresses focusing mainly in developing new varieties that can tolerate water shortage for longer periods.

Suboptimal nutrient (macro and micro nutrient) affect plant growth and development through the whole plant life cycle. One of the essential macronutrients for the plant is Nitrogen. Nitrogen is responsible for biosynthesis of amino acids and nucleic acids, prosthetic groups, plant hormones, plant chemical defenses, and the like. Nitrogen is often the rate-limiting element in plant growth and all field crops have a fundamental dependence on inorganic nitrogenous fertilizer. Since fertilizer is rapidly depleted from most soil types, it must be supplied to growing crops two or three times during the growing season. Additional important macronutrients are Phosphorous (P) and Potassium (K), which have a direct correlation to yield and general plant tolerance.

Vegetable or seed oils are the major source of energy and nutrition in human and animal diet. They are also used for the production of industrial products, such as paints, inks and lubricants. In addition, plant oils represent renewable sources of long-chain hydrocarbons which can be used as fuel. Since the currently used fossil fuels are finite resources and are gradually being depleted, fast growing biomass crops may be used as alternative fuels or for energy feedstocks and may reduce the dependence on fossil energy supplies. However, the major bottleneck for increasing consumption of plant oils as bio-fuel is the oil price, which is still higher than fossil fuel [Hypertext Transfer Protocol://World Wide Web (dot) eia (dot) doe (dot) gov/oiaf/analysispaper/biodiesel/; Hypertext Transfer Protocol://World Wide Web (dot) njbiz (dot)com/ weekly article.asp?aID=19755147 (dot) 6122555 (dot) 957931 (dot) 7393254 (dot) 4337383 (dot) 561&aID2=73678]. In addition, the production rate of plant oil is limited by the availability of agricultural land and water. Thus, increasing plant oil yields from the same growing area can effectively overcome the shortage in production space and can decrease vegetable oil prices at the same time.

Studies aiming at increasing plant oil yields focus on the identification of genes involved in oil metabolism as well as in genes capable of increasing plant and seed yields in transgenic plants.

Genes known to be involved in increasing plant oil yields include those participating in fatty acid synthesis or sequestering such as desaturase [e.g., DELTA6, DELTA12 or acyl-ACP (Ssi2; Arabidopsis Information Resource (TAIR; Hypertext Transfer Protocol://World Wide Web (dot) arabidopsis (dot) org/), TAIR No. AT2G43710)], OleosinA (TAIR No. AT3G01570) or FAD3 (TAIR No. AT2G29980), and various transcription factors and activators such as Lec1 [TAIR No. AT1G21970, Lotan et al. 1998. Cell. 26;93(7): 1195-205], Lec2 [TAIR No. AT1G28300, Santos Mendoza et al. 2005, FEBS Lett. 579(20:4666-70], Fus3 (TAIR No. AT3G26790), ABI3 [TAIR No. AT3G24650, Lara et al. 2003. J Biol Chem. 278(23): 21003-11] and Wri1 [TAIR No. AT3G54320, Cernac and Benning, 2004. Plant J. 40(4): 575-85].

Zabrouskov V., et al., 2002 (Physiol Plant. 116:172-185) describe an increase in the total lipid fraction by upregulation of endoplasmic reticulum (FAD3) and plastidal (FAD7) fatty acid desaturases in potato.

Wang H W et al., 2007 (Plant J. 52:716-29. Epub Sep. 18, 2007) describe an increase in the content of total fatty acids and lipids in plant seeds by over-expressing the GmDof4 and GmDof11 transcription factors.

Vigeolas H, et al. [Plant Biotechnol J. 2007, 5(3):431-41] and U.S. Pat. Appl. No. 20060168684 discloses an increase in seed oil content in oil-seed rape (Brassica napus L.) by over-expression of a yeast glycerol-3-phosphate dehydrogenase under the control of a seed-specific promoter.

Katavic V, et al., 2000 (Biochem Soc Trans. 28:935-7) describe the use of the Arabidopsis FAE1 and yeast SLC1-1 genes for improvements in erucic acid and oil content in rapeseed.

U.S. Pat. Appl. No. 20080076179 discloses an isolated moss nucleic acid encoding a lipid metabolism protein (LMP) and transgenic plants expressing same with increased lipid levels.

U.S. Pat. Appl. No. 20060206961 discloses a method of increasing oil content in plants (e.g., in plant seeds), by expressing in the plant the Ypr140w polypeptide.

U.S. Pat. Appl. No. 20060174373 discloses a method of increasing oil content in plants by expressing a nucleic acid encoding a triacylglycerols (TAG) synthesis enhancing protein (TEP) in the plant.

U.S. Pat. Appl. Nos. 20070169219, 20070006345, 20070006346 and 20060195943, disclose transgenic plants with improved nitrogen use efficiency which can be used for the conversion into fuel or chemical feedstocks.

WO2004/104162 teaches polynucleotide sequences and methods of utilizing same for increasing the tolerance of a plant to abiotic stresses and/or increasing the biomass of a plant.

WO2007/020638 teaches polynucleotide sequences and methods of utilizing same for increasing the tolerance of a plant to abiotic stresses and/or increasing the biomass, vigor and/or yield of a plant.

WO2008/122890 teaches polynucleotide sequences and methods of utilizing same for increasing oil content, growth rate, biomass, yield and/or vigor of a plant.

SUMMARY OF THE INVENTION

According to an aspect of some embodiments of the present invention there is provided a method of increasing yield, biomass, growth rate, vigor, oil content, abiotic stress tolerance and/or nitrogen use efficiency of a plant, comprising expressing within the plant an exogenous polynucleotide comprising a nucleic acid sequence at least 80% identical to SEQ ID NO: 905, 882, 1-12, 15-105, 203-297, 299-523, 845-881, 883-904, 906-925 or 933, thereby increasing the yield, biomass, growth rate, vigor, oil content, abiotic stress tolerance and/or nitrogen use efficiency of the plant.

According to an aspect of some embodiments of the present invention there is provided a method of increasing yield, biomass, growth rate, vigor, oil content, abiotic stress tolerance and/or nitrogen use efficiency of a plant, comprising expressing within the plant an exogenous polynucleotide comprising the nucleic acid sequence selected from the group consisting of SEQ ID NOs: 905, 882, 1-13, 15-105, 203-523, 845-881, 883-904, 906-925 and 933, thereby increasing the yield, biomass, growth rate, vigor, oil content, abiotic stress tolerance and/or nitrogen use efficiency of the plant.

According to an aspect of some embodiments of the present invention there is provided a method of increasing yield, biomass, growth rate, vigor, oil content, abiotic stress tolerance and/or nitrogen use efficiency of a plant, comprising expressing within the plant an exogenous polynucleotide comprising a nucleic acid sequence encoding a polypeptide at least 80% identical to SEQ ID NO: 172, 146, 106-117, 120-145, 147-171, 173-202, 524-616, 621-844, 926-931 or 932, thereby increasing the yield, biomass, growth rate, vigor, oil content, abiotic stress tolerance and/or nitrogen use efficiency of the plant.

According to an aspect of some embodiments of the present invention there is provided a method of increasing yield, biomass, growth rate, vigor, oil content, abiotic stress tolerance and/or nitrogen use efficiency of a plant, comprising expressing within the plant an exogenous polynucleotide comprising a nucleic acid sequence encoding a polypeptide selected from the group consisting of SEQ ID NOs: 172, 146, 106-117, 120-145, 147-171, 173-202, 524-844 and 926-932, thereby increasing the yield, biomass, growth rate, vigor, oil content, abiotic stress tolerance and/or nitrogen use efficiency of the plant.

According to an aspect of some embodiments of the present invention there is provided an isolated polynucleotide comprising a nucleic acid sequence at least 80% identical to SEQ ID NO: 905, 882, 1-12, 15-105, 203-297, 299-523, 845-881, 883-904, 906-925 or 933, wherein said nucleic acid sequence is capable of increasing yield, biomass, growth rate, vigor, oil content, abiotic stress tolerance and/or nitrogen use efficiency of a plant.

According to an aspect of some embodiments of the present invention there is provided an isolated polynucleotide comprising the nucleic acid sequence selected from the group consisting of SEQ ID NOs: 905, 882, 1-13, 15-105, 203-523, 845-881, 883-904, 906-925 and 933.

According to an aspect of some embodiments of the present invention there is provided an isolated polynucleotide comprising a nucleic acid sequence encoding a polypeptide which comprises an amino acid sequence at least 80% homologous to the amino acid sequence set forth in SEQ ID NO: 172, 146, 106-117, 120-145, 147-171, 173-202, 524-616, 621-844, 926-931 or 932, wherein said amino acid sequence is capable of increasing yield, biomass, growth rate, vigor, oil content, abiotic stress tolerance and/or nitrogen use efficiency of a plant.

According to an aspect of some embodiments of the present invention there is provided an isolated polynucleotide comprising a nucleic acid sequence encoding a polypeptide which comprises the amino acid sequence selected from the group consisting of SEQ ID NOs: 172, 146, 106-117, 120-145, 147-171, 173-202, 524-844 and 926-932.

According to an aspect of some embodiments of the present invention there is provided a nucleic acid construct comprising the isolated polynucleotide of the invention, and a promoter for directing transcription of said nucleic acid sequence in a host cell.

According to an aspect of some embodiments of the present invention there is provided an isolated polypeptide comprising an amino acid sequence at least 80% homologous to SEQ ID NO: 172, 146, 106-117, 120-145, 147-171, 173-202, 524-616, 621-844, 926-931 or 932, wherein said amino acid sequence is capable of increasing yield, biomass, growth rate, vigor, oil content, abiotic stress tolerance and/or nitrogen use efficiency of a plant.

According to an aspect of some embodiments of the present invention there is provided an isolated polypeptide comprising the amino acid sequence selected from the group consisting of SEQ ID NOs: 172, 146, 106-117, 120-145, 147-171, 173-202, 524-844 and 926-932.

According to an aspect of some embodiments of the present invention there is provided a plant cell exogenously expressing the polynucleotide of the invention, or the nucleic acid construct of the invention.

According to an aspect of some embodiments of the present invention there is provided a plant cell exogenously expressing the polypeptide of the invention.

According to some embodiments of the invention, the nucleic acid sequence is as set forth in SEQ ID NO: 905, 882, 1-13, 15-105, 203-523, 845-881, 883-904, 906-925 or 933.

According to some embodiments of the invention, the polynucleotide consists of the nucleic acid sequence selected from the group consisting of SEQ ID NOs: 905, 882, 1-13, 15-105, 203-523, 845-881, 883-904, 906-925 and 933.

According to some embodiments of the invention, the nucleic acid sequence encodes an amino acid sequence at least 80% homologous to SEQ ID NO: 172, 146, 106-117, 120-145, 147-171, 173-202, 524-616, 621-844, 926-931 or 932.

According to some embodiments of the invention, the nucleic acid sequence encodes the amino acid sequence selected from the group consisting of SEQ ID NOs: 172, 146, 106-117, 120-145, 147-171, 173-202, 524-844 and 926-932.

According to some embodiments of the invention, the plant cell forms part of a plant.

According to some embodiments of the invention, the method further comprising growing the plant expressing said exogenous polynucleotide under the abiotic stress.

According to some embodiments of the invention, the abiotic stress is selected from the group consisting of salinity, drought, water deprivation, flood, etiolation, low temperature, high temperature, heavy metal toxicity, anaerobiosis, nutrient deficiency, nutrient excess, atmospheric pollution and UV irradiation.

According to some embodiments of the invention, the yield comprises seed yield or oil yield.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 3A-F are images depicting visualization of root development of transgenic plants exogenously expressing the polynucleotide of some embodiments of the invention when grown in transparent agar plates under normal (FIGS. 3A-B), osmotic stress (15% PEG; FIGS. 3C-D) or nitrogen-limiting (FIGS. 3E-F) conditions. The different transgenes were grown in transparent agar plates for 17 days (7 days nursery and 10 days after transplanting). The plates were photographed every 3-4 days starting at day 1 after transplanting. FIG. 3A—An image of a photograph of plants taken following 10 after transplanting days on agar plates when grown under normal (standard) conditions. FIG. 3B—An image of root analysis of the plants shown in FIG. 3A in which the lengths of the roots measured are represented by arrows. FIG. 3C—An image of a photograph of plants taken following 10 days after transplanting on agar plates, grown under high osmotic (PEG 15%) conditions. FIG. 3D—An image of root analysis of the plants shown in FIG. 3C in which the lengths of the roots measured are represented by arrows. FIG. 3E—An image of a photograph of plants taken following 10 days after transplanting on agar plates, grown under low nitrogen conditions. FIG. 3F—An image of root analysis of the plants shown in FIG. 3E in which the lengths of the roots measured are represented by arrows.

DESCRIPTION OF SPECIFIC EMBODIMENTS OF THE INVENTION

Figure 1:
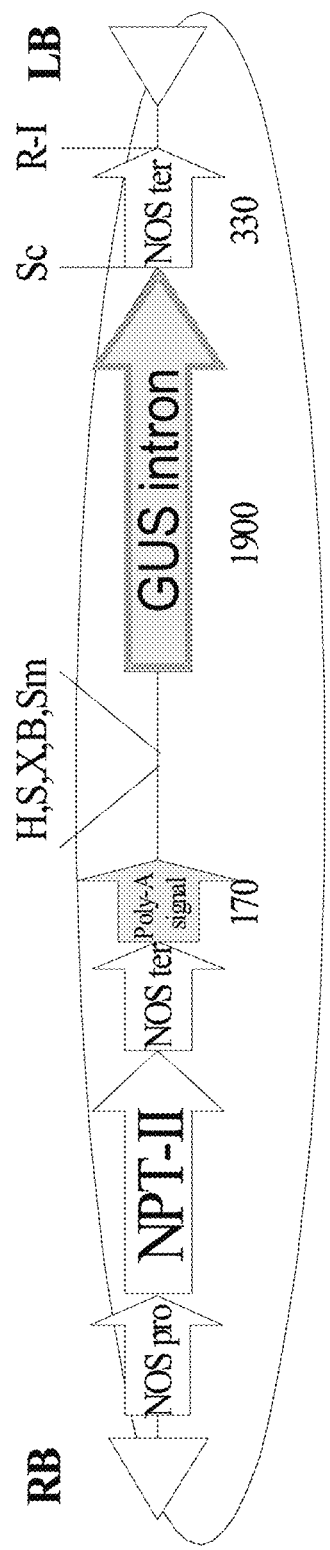
FIG. 1 is a schematic illustration of the pGI binary plasmid used for expressing the isolated polynucleotide sequences of some embodiments of the invention. RB—T-DNA right border; LB—T-DNA left border; H—HindIII restriction enzyme; X—XbaI restriction enzyme; B—BamHI restriction enzyme; S—SalI restriction enzyme; Sm—SmaI restriction enzyme; R-I—EcoRI restriction enzyme; Sc—SacI/SstI/Ecl136II; (numbers)—Length in base-pairs; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron) The isolated polynucleotide sequences of the invention were cloned into the vector while replacing the GUSintron reporter gene
Figure 2:
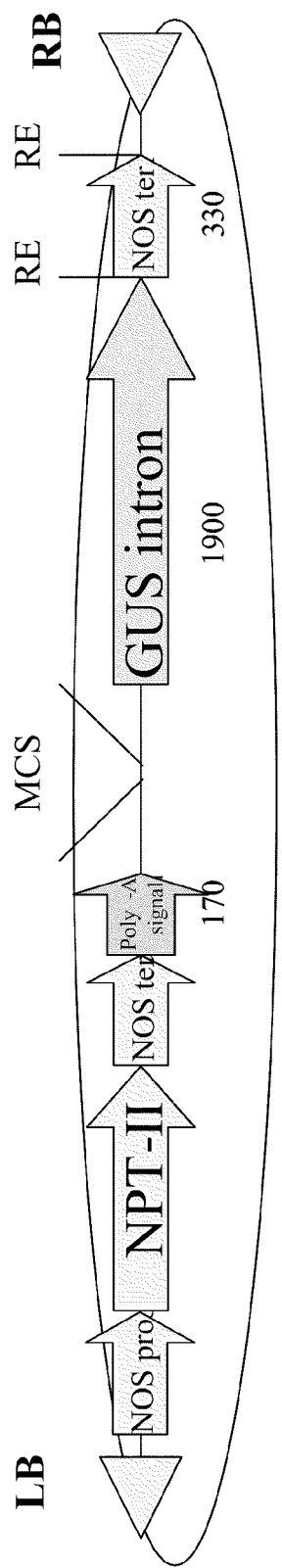
FIG. 2 is a schematic illustration of the modified pGI binary plasmid used for expressing the isolated polynucleotide sequences of the invention. RB—T-DNA right border; LB—T-DNA left border; MCS—Multiple cloning site; RE—any restriction enzyme; (numbers)—Length in base-pairs; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron) The isolated polynucleotide sequences of the invention were cloned into the vector while replacing the GUSintron reporter gene.

The present invention, in some embodiments thereof, relates to polypeptides, polynucleotides encoding same, nucleic acid constructs comprising same, transgenic plants expressing same and methods of producing and using same for increasing plant yield, oil yield, seed yield, biomass, growth rate, vigor, oil content, abiotic stress tolerance and/or nitrogen use efficiency.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

While reducing the present invention to practice, the present inventors have identified novel polypeptides and polynucleotides which can be used to increase yield, growth rate, biomass, oil content, vigor, abiotic stress tolerance and/or nitrogen use efficiency of a plant.

Thus, as shown in the Examples section which follows, the present inventors have utilized bioinformatics tools and microarray analyses to identify polynucleotides which enhance yield (e.g., seed yield, oil yield, oil content), growth rate, biomass, vigor, abiotic stress tolerance and/or nitrogen use efficiency of a plant. Genes which affect the trait-of-interest [Table 15; Example 5 of the Examples section which follows; SEQ ID NOs:1-105 (polynucleotides) and SEQ ID NOs:106-202 (polypeptides)] were identified based on correlation analyses between expression profiles of various genes in tissues, developmental stages, fertilizer limiting conditions, abiotic stress conditions or normal conditions across several *Arabidopsis* ecotypes, *Sorghum* Accessions and Tomato accessions and various parameters of yield, biomass, vigor, growth rate and/or oil content (Examples 1, 2, 3, 4, 10 and 11 of the Examples section which follows; Tables 1, 2, 3, 4, 5, 6, 7, 8, 9, 10, 11, 12, 13, 14, 28 and 29). Homologous polypeptides and polynucleotides having the same function (activity) were also identified [Table 16, Example 6 of the Examples section which follows; SEQ ID NOs:203-523 (polynucleotides), and SEQ ID NOs:524-844 (polypeptides)]. The identified genes were cloned in binary vectors (see for example, Tables 17, 18, 19 and 20; Example 7 of the Examples section which follows; SEQ ID NOs:47, 845-925 and 933) and transgenic plants over-expressing the identified genes of the invention were generated (see for example, Example 8 of the Examples section which follows). These plants which are transformed with the identified polynucleotides were found to exhibit increased yield, biomass, growth rate, vigor, seed yield, oil content, oil yield, flowering, harvest index and rosette area (Tables 21-27; Example 9 of the Examples section which follows). These results suggest the use of the novel polynucleotides and polypeptides of the invention for increasing yield (including oil yield, seed yield and oil content), growth rate, biomass, vigor, abiotic stress tolerance and/or nitrogen use efficiency of a plant.

Thus, according to an aspect of some embodiments of the invention, there is provided method of increasing yield, biomass, growth rate, vigor, oil content, abiotic stress tolerance and/or nitrogen use efficiency of a plant. The method is effected by expressing within the plant an exogenous polynucleotide comprising a nucleic acid sequence at least 80% identical to SEQ ID NO: 905, 882, 1-12, 15-105, 203-297, 299-523, 845-881, 883-904, 906-925, or 933, thereby increasing the yield, biomass, growth rate, vigor, oil content, abiotic stress tolerance and/or nitrogen use efficiency of the plant.

As used herein the phrase "plant yield" refers to the amount (as determined by weight or size) or quantity (numbers) of tissues or organs produced per plant or per growing season. Hence increased yield could affect the economic benefit one can obtain from the plant in a certain growing area and/or growing time.

It should be noted that a plant yield can be affected by various parameters including, but not limited to, plant biomass; plant vigor; growth rate; seed yield; seed or grain quantity; seed or grain quality; oil yield; content of oil, starch and/or protein in harvested organs (e.g., seeds or vegetative parts of the plant); number of flowers (florets) per panicle (expressed as a ratio of number of filled seeds over number of primary panicles); harvest index; number of plants grown per area; number and size of harvested organs per plant and per area; number of plants per growing area (density); number of harvested organs in field; total leaf area; carbon assimilation and carbon partitioning (the distribution/allocation of carbon within the plant); resistance to shade; number of harvestable organs (e.g. seeds), seeds per pod, weight per seed; and modified architecture [such as increase stalk diameter, thickness or improvement of physical properties (e.g. elasticity)].

As used herein the phrase "seed yield" refers to the number or weight of the seeds per plant, seeds per pod, or per growing area or to the weight of a single seed, or to the oil extracted per seed. Hence seed yield can be affected by seed dimensions (e.g., length, width, perimeter, area and/or volume), number of (filled) seeds and seed filling rate and by seed oil content. Hence increase seed yield per plant could affect the economic benefit one can obtain from the plant in a certain growing area and/or growing time; and increase seed yield per growing area could be achieved by increasing seed yield per plant, and/or by increasing number of plants grown on the same given area.

The term "seed" (also referred to as "grain" or "kernel") as used herein refers to a small embryonic plant enclosed in a covering called the seed coat (usually with some stored food), the product of the ripened ovule of gymnosperm and angiosperm plants which occurs after fertilization and some growth within the mother plant.

The phrase "oil content" as used herein refers to the amount of lipids in a given plant organ, either the seeds (seed oil content) or the vegetative portion of the plant (vegetative oil content) and is typically expressed as percentage of dry weight (10% humidity of seeds) or wet weight (for vegetative portion).

It should be noted that oil content is affected by intrinsic oil production of a tissue (e.g., seed, vegetative portion), as well as the mass or size of the oil-producing tissue per plant or per growth period.

In one embodiment, increase in oil content of the plant can be achieved by increasing the size/mass of a plant's tissue(s) which comprise oil per growth period. Thus, increased oil content of a plant can be achieved by increasing the yield, growth rate, biomass and vigor of the plant.

As used herein the phrase "plant biomass" refers to the amount (e.g., measured in grams of air-dry tissue) of a tissue produced from the plant in a growing season, which could also determine or affect the plant yield or the yield per growing area. An increase in plant biomass can be in the whole plant or in parts thereof such as aboveground (harvestable) parts, vegetative biomass, roots and seeds.

As used herein the phrase "growth rate" refers to the increase in plant organ/tissue size per time (can be measured in $cm^2$ per day).

As used herein the phrase "plant vigor" refers to the amount (measured by weight) of tissue produced by the plant in a given time. Hence increased vigor could determine or affect the plant yield or the yield per growing time or growing area. In addition, early vigor (seed and/or seedling) results in improved field stand.

It should be noted that a plant yield can be determined under stress (e.g., abiotic stress, nitrogen-limiting conditions) and/or non-stress (normal) conditions.

As used herein, the phrase "non-stress conditions" refers to the growth conditions (e.g., water, temperature, light-dark cycles, humidity, salt concentration, fertilizer concentration in soil, nutrient supply such as nitrogen, phosphorous and/or potassium), that do not significantly go beyond the everyday climatic and other abiotic conditions that plants may encounter, and which allow optimal growth, metabolism, reproduction and/or viability of a plant at any stage in its life cycle (e.g., in a crop plant from seed to a mature plant and back to seed again). Persons skilled in the art are aware of normal soil conditions and climatic conditions for a given plant in a given geographic location. It should be noted that while the non-stress conditions may include some mild variations from the optimal conditions (which vary from one type/species of a plant to another), such variations do not cause the plant to cease growing without the capacity to resume growth.

The phrase "abiotic stress" as used herein refers to any adverse effect on metabolism, growth, reproduction and/or viability of a plant. Accordingly, abiotic stress can be induced by suboptimal environmental growth conditions such as, for example, salinity, water deprivation, flooding, freezing, low or high temperature, heavy metal toxicity, anaerobiosis, nutrient deficiency, atmospheric pollution or UV irradiation. The implications of abiotic stress are discussed in the Background section.

The phrase "abiotic stress tolerance" as used herein refers to the ability of a plant to endure an abiotic stress without suffering a substantial alteration in metabolism, growth, productivity and/or viability.

As used herein the phrase "water use efficiency (WUE)" refers to the level of organic matter produced per unit of water consumed by the plant, i.e., the dry weight of a plant in relation to the plant's water use, e.g., the biomass produced per unit transpiration.

As used herein the phrase "fertilizer use efficiency" refers to the metabolic process(es) which lead to an increase in the plant's yield, biomass, vigor, and growth rate per fertilizer unit applied. The metabolic process can be the uptake, spread, absorbent, accumulation, relocation (within the plant) and use of one or more of the minerals and organic moieties absorbed by the plant, such as nitrogen, phosphates and/or potassium.

As used herein the phrase "fertilizer-limiting conditions" refers to growth conditions which include a level (e.g., concentration) of a fertilizer applied which is below the level needed for normal plant metabolism, growth, reproduction and/or viability. As used herein the phrase "nitrogen use efficiency (NUE)" refers to the metabolic process(es) which lead to an increase in the plant's yield, biomass, vigor, and growth rate per nitrogen unit applied. The metabolic process can be the uptake, spread, absorbent, accumulation, relocation (within the plant) and use of nitrogen absorbed by the plant.

As used herein the phrase "nitrogen-limiting conditions" refers to growth conditions which include a level (e.g., concentration) of nitrogen (e.g., ammonium or nitrate) applied which is below the level needed for normal plant metabolism, growth, reproduction and/or viability.

Improved plant NUE and FUE is translated in the field into either harvesting similar quantities of yield, while implementing less fertilizers, or increased yields gained by implementing the same levels of fertilizers. Thus, improved NUE or FUE has a direct effect on plant yield in the field. Thus, the polynucleotides and polypeptides of some embodiments of the invention positively affect plant yield, seed yield, and plant biomass. In addition, the benefit of improved plant NUE will certainly improve crop quality and biochemical constituents of the seed such as protein yield and oil yield.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80%, increase in yield, growth rate, biomass, vigor, oil content, abiotic stress tolerance and/or nitrogen use efficiency of a plant as compared to a native plant [i.e., a plant not modified with the biomolecules (polynucleotide or polypeptides) of the invention, e.g., a non-transformed plant of the same species which is grown under the same growth conditions].

The phrase "expressing within the plant an exogenous polynucleotide" as used herein refers to upregulating the expression level of an exogenous polynucleotide within the plant by introducing the exogenous polynucleotide into a plant cell or plant and expressing by recombinant means, as further described herein below.

As used herein "expressing" refers to expression at the mRNA and optionally polypeptide level.

As used herein, the phrase "exogenous polynucleotide" refers to a heterologous nucleic acid sequence which may not be naturally expressed within the plant or which overexpression in the plant is desired. The exogenous polynucleotide may be introduced into the plant in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the plant.

The term "endogenous" as used herein refers to any polynucleotide or polypeptide which is present and/or naturally expressed within a plant or a cell thereof.

According to some embodiments of the invention the exogenous polynucleotide comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 905, 882, 1-12, 15-105, 203-297, 299-523, 845-881, 883-904, 906-925 and 933.

Identity (e.g., percent homology) can be determined using any homology comparison software, including for example, the BlastN software of the National Center of Biotechnology Information (NCBI) such as by using default parameters.

According to some embodiments of the invention the exogenous polynucleotide is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 905, 882, 1-12, 15-105, 203-297, 299-523, 845-881, 883-904, 906-925 and 933.

According to some embodiments of the invention the exogenous polynucleotide is set forth by SEQ ID NO: 905, 882, 1-12, 15-105, 203-297, 299-523, 845-881, 883-904, 906-925 or 933.

According to an aspect of some embodiments of the invention, there is provided a method of increasing yield, biomass, growth rate, vigor, oil content, abiotic stress tolerance and/or nitrogen use efficiency of a plant. The method is effected by expressing within the plant an exogenous polynucleotide comprising the nucleic acid sequence selected from the group consisting of SEQ ID NOs: 905, 882, 1-13, 15-105, 203-523, 845-881, 883-904, 906-925 and 933, thereby increasing the yield, biomass, growth rate, vigor, oil content, abiotic stress tolerance and/or nitrogen use efficiency of the plant.

According to some embodiments of the invention the exogenous polynucleotide is selected from the group consisting of SEQ ID NOs: 905, 882, 1-13, 15-105, 203-523, 845-881, 883-904, 906-925 and 933.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

The term "isolated" refers to at least partially separated from the natural environment e.g., from a plant cell.

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

According to some embodiments of the invention, the exogenous polynucleotide of the invention encodes a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 172, 146, 106-117, 120-145, 147-171, 173-202, 524-616, 621-844, 926-931 and 932.

Homology (e.g., percent homology) can be determined using any homology comparison software, including for example, the BlastP or TBLASTN software of the National Center of Biotechnology Information (NCBI) such as by using default parameters, when starting from a polypeptide sequence; or the tBLASTX algorithm (available via the NCBI) such as by using default parameters, which compares the six-frame conceptual translation products of a nucleotide query sequence (both strands) against a protein sequence database.

Homologous sequences include both orthologous and paralogous sequences. The term "paralogous" relates to gene-duplications within the genome of a species leading to paralogous genes. The term "orthologous" relates to homologous genes in different organisms due to ancestral relationship.

One option to identify orthologues in monocot plant species is by performing a reciprocal blast search. This may be done by a first blast involving blasting the sequence-of-interest against any sequence database, such as the publicly available NCBI database which may be found at: Hypertext Transfer Protocol://World Wide Web (dot) ncbi (dot) nlm (dot) nih (dot) gov. If orthologues in rice were sought, the sequence-of-interest would be blasted against, for example, the 28,469 full-length cDNA clones from Oryza sativa Nipponbare available at NCBI. The blast results may be filtered. The full-length sequences of either the filtered results or the non-filtered results are then blasted back (second blast) against the sequences of the organism from which the sequence-of-interest is derived. The results of the first and second blasts are then compared. An orthologue is identified when the sequence resulting in the highest score (best hit) in the first blast identifies in the second blast the query sequence (the original sequence-of-interest) as the best hit. Using the same rational a paralogue (homolog to a gene in the same organism) is found. In case of large sequence families, the ClustalW program may be used [Hypertext Transfer Protocol://World Wide Web (dot) ebi (dot) ac (dot) uk/Tools/clustalw2/index (dot) html], followed by a neighbor-joining tree (Hypertext Transfer Protocol://en (dot) wikipedia (dot) org/wiki/Neighbor-joining) which helps visualizing the clustering.

According to some embodiments of the invention, the exogenous polynucleotide encodes a polypeptide consisting of the amino acid sequence set forth by SEQ ID NO: 172, 146, 106-117, 120-145, 147-171, 173-202, 524-616, 621-844, 926-931 or 932.

According to an aspect of some embodiments of the invention, the method of increasing yield, biomass, growth rate, vigor, oil content, abiotic stress tolerance and/or nitrogen use efficiency of a plant is effected by expressing within the plant an exogenous polynucleotide comprising the nucleic acid sequence encoding a polypeptide selected from the group consisting of SEQ ID NOs: 172, 146, 106-117, 120-145, 147-171, 173-202, 524-844 and 926-932, thereby increasing the yield, biomass, growth rate, vigor, oil content, abiotic stress tolerance and/or nitrogen use efficiency of the plant.

Nucleic acid sequences encoding the polypeptides of the present invention may be optimized for expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1 N [(Xn−Yn)/Yn] 2/N, where Xn refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (Hypertext Transfer Protocol://World Wide Web (dot) kazusa (dot) or (dot) jp/codon/). The Codon Usage Database contains codon usage tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

According to some embodiments of the invention, the exogenous polynucleotide is a non-coding RNA.

As used herein the phrase "non-coding RNA" refers to an RNA molecule which does not encode an amino acid sequence (a polypeptide). Examples of such non-coding RNA molecules include, but are not limited to, an antisense RNA, a pre-miRNA (precursor of a microRNA), or a precursor of a Piwi-interacting RNA (piRNA).

A non-limiting example of a non-coding RNA polynucleotide is provided in SEQ ID NO:72 (BDL90).

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

The invention provides an isolated polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 905, 882, 1-12, 15-105, 203-297, 299-523, 845-881, 883-904, 906-925 and 933.

According to some embodiments of the invention the nucleic acid sequence is capable of increasing yield, growth rate, vigor, biomass, oil content, abiotic stress tolerance and/or nitrogen use efficiency of a plant.

According to some embodiments of the invention the isolated polynucleotide comprising the nucleic acid sequence selected from the group consisting of SEQ ID NOs: 905, 882, 1-13, 15-105, 203-523, 845-881, 883-904, 906-925 and 933.

According to some embodiments of the invention the isolated polynucleotide is set forth by SEQ ID NO: 905, 882, 1-13, 15-105, 203-523, 845-881, 883-904, 906-925 or 933.

The invention provides an isolated polynucleotide comprising a nucleic acid sequence encoding a polypeptide which comprises an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to the amino acid sequence selected from the group consisting of SEQ ID NOs: 172, 146, 106-117, 120-145, 147-171, 173-202, 524-616, 621-844, 926-931 and 932.

According to some embodiments of the invention the amino acid sequence is capable of increasing yield, growth rate, vigor, biomass, oil content, abiotic stress tolerance and/or nitrogen use efficiency of a plant.

The invention provides an isolated polynucleotide comprising a nucleic acid sequence encoding a polypeptide which comprises the amino acid sequence selected from the group consisting of SEQ ID NOs: 172, 146, 106-117, 120-145, 147-171, 173-202, 524-844 and 926-932.

The invention provides an isolated polynucleotide comprising a nucleic acid sequence encoding a polypeptide selected from the group consisting of SEQ ID NOs: 172, 146, 106-117, 120-145, 147-171, 173-202, 524-844 and 926-932.

The invention provides an isolated polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to an amino acid sequence selected from the group consisting of SEQ ID NOs: 172, 146, 106-117, 120-145, 147-171, 173-202, 524-616, 621-844, 926-931 and 932.

According to some embodiments of the invention, the polypeptide comprising an amino acid sequence selected from the group consisting of SEQ ID NOs: 172, 146, 106-117, 120-145, 147-171, 173-202, 524-844 and 926-932.

According to some embodiments of the invention, the polypeptide is set forth by SEQ ID NO: 172, 146, 106-117, 120-145, 147-171, 173-202, 524-844, 926-931 or 932.

The invention also encompasses fragments of the above described polypeptides and polypeptides having mutations, such as deletions, insertions or substitutions of one or more amino acids, either naturally occurring or man induced, either randomly or in a targeted fashion.

The term "plant" as used herein encompasses whole plants, ancestors and progeny of the plants and plant parts, including seeds, shoots, stems, roots (including tubers), and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the super-family Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis*, *Albizia amara*, *Alsophila tricolor*, *Andropogon* spp., *Arachis* spp, *Areca catechu*, *Astelia fragrans*, *Astragalus cicer*, *Baikiaea plurijuga*, *Betula* spp., *Brassica* spp., *Bruguiera gymnorrhiza*, *Burkea africana*, *Butea frondosa*, *Cadaba farinosa*, *Calliandra* spp, *Camellia sinensis*, *Canna indica*, *Capsicum* spp., *Cassia* spp., *Centroema pubescens*, *Chacoomeles* spp., *Cinnamomum cassia*, *Coffea arabica*, *Colophospermum mopane*, *Coronillia varia*, *Cotoneaster serotina*, *Crataegus* spp., *Cucumis* spp., *Cupressus* spp., *Cyathea dealbata*, *Cydonia oblonga*, *Cryptomeria japonica*, *Cymbopogon* spp., *Cynthea dealbata*, *Cydonia oblonga*, *Dalbergia monetaria*, *Davallia divaricata*, *Desmodium* spp., *Dicksonia squarosa*, *Dibeteropogon amplectens*, *Dioclea* spp, *Dolichos* spp., *Dorycnium rectum*, *Echinochloa pyramidalis*, *Ehraffia* spp., *Eleusine coracana*, *Eragrestis* spp., *Erythrina* spp., *Eucalypfus* spp., *Euclea schimperi*, *Eulalia vi/losa*, *Pagopyrum* spp., *Feijoa sellowlana*, *Fragaria* spp., *Flemingia* spp, *Freycinetia banksli*, *Geranium thunbergii*, *GinAgo biloba*, *Glycine javanica*, *Gliricidia* spp, *Gossypium hirsutum*, *Grevillea* spp., *Guibourtia coleosperma*, *Hedysarum* spp., *Hemaffhia altissima*, *Heteropogon contoffus*, *Hordeum vulgare*, *Hyparrhenia rufa*, *Hypericum erectum*, *Hypeffhelia dissolute*, *Indigo incamata*, *Iris* spp., *Leptarrhena pyrolifolia*, *Lespediza* spp., *Lettuca* spp., *Leucaena leucocephala*, *Loudetia simplex*, *Lotonus bainesli*, *Lotus* spp., *Macrotyloma axillare*, *Malus* spp., *Manihot esculenta*, *Medicago saliva*, *Metasequoia glyptostroboides*, *Musa sapientum*, *Nicotianum* spp., *Onobrychis* spp., *Ornithopus* spp., *Oryza* spp., *Peltophorum africanum*, *Pennisetum* spp., *Persea* gratissima, Petunia spp., Phaseolus spp., Phoenix canariensis, Phormium cookianum, Photinia spp., Picea glauca, Pinus spp., Pisum sativam, Podocarpus totara, Pogonarthria fleckii, Pogonaffhria squarrosa, Populus spp., Prosopis cineraria, Pseudotsuga menziesii, Pterolobium stellatum, Pyrus communis, Quercus spp., Rhaphiolepsis umbellata, Rhopalostylis sapida, Rhus natalensis, Ribes grossularia, Ribes spp., Robinia pseudoacacia, Rosa spp., Rubus spp., Salix spp., Schyzachyrium sanguineum, Sciadopitys vefficillata, Sequoia sempervirens, Sequoiadendron giganteum, Sorghum bicolor, Spinacia spp., Sporobolus fimbriatus, Stiburus alopecuroides, Stylosanthos humilis, Tadehagi spp, Taxodium distichum, Themeda triandra, Trifolium spp., Triticum spp., Tsuga heterophylla, Vaccinium spp., Vicia spp., Vitis vinifera, Watsonia pyramidata, Zantedeschia aethiopica, Zea mays, amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barely, rye, oat, peanut, pea, lentil and alfalfa, cotton, rapeseed, canola, pepper, sunflower, tobacco, eggplant, eucalyptus, a tree, an ornamental plant, a perennial grass and a forage crop. Alternatively algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, lupinus, rapeseed, tobacco, poplar and cotton.

According to some embodiments of the invention, there is provided a plant cell exogenously expressing the polynucleotide of some embodiments of the invention, the nucleic acid construct of some embodiments of the invention and/or the polypeptide of some embodiments of the invention.

According to some embodiments of the invention, expressing the exogenous polynucleotide of the invention within the plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

According to some embodiments of the invention, there is provided a nucleic acid construct comprising the isolated polynucleotide of the invention, and a promoter for directing transcription of the nucleic acid sequence of the isolated polynucleotide in a host cell.

According to some embodiments of the invention, the isolated polynucleotide is operably linked to the promoter sequence. A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

Any suitable promoter sequence can be used by the nucleic acid construct of the present invention. Preferably the promoter is a constitutive promoter, a tissue-specific, or an abiotic stress-inducible promoter.

Suitable constitutive promoters include, for example, CaMV 35S promoter (SEQ ID NO:1184; Odell et al., Nature 313:810-812, 1985); Arabidopsis At6669 promoter (SEQ ID NO:1183; see PCT Publication No. WO04081173A2); maize Ubi 1 (Christensen et al., Plant Sol. Biol. 18:675-689, 1992); rice actin (McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); GOS2 (de Pater et al, Plant J November; 2(6):837-44, 1992); ubiquitin (Christensen et al, Plant Mol. Biol. 18: 675-689, 1992); Rice cyclophilin (Bucholz et al, Plant Mol Biol. 25(5):837-43, 1994); Maize H3 histone (Lepetit et al, Mol. Gen. Genet. 231: 276-285, 1992); Actin 2 (An et al, Plant J. 10(1);107-121, 1996) and Synthetic Super MAS (Ni et al., The Plant Journal 7: 661-76, 1995). Other constitutive promoters include those in U.S. Pat. Nos. 5,659,026, 5,608,149; 5.608,144; 5,604,121; 5,569,597: 5,466,785; 5,399,680; 5,268,463; and 5,608,142.

Suitable tissue-specific promoters include, but not limited to, leaf-specific promoters [such as described, for example, by Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993], seed-preferred promoters [e.g., from seed specific genes (Simon, et al., Plant Mol. Biol. 5. 191, 1985; Scofield, et al., J. Biol. Chem. 262: 12202, 1987; Baszczynski, et al., Plant Mol. Biol. 14: 633, 1990), Brazil Nut albumin (Pearson' et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al Plant Mol Biol, 143).323-32 1990), napA (Stalberg, et al, Planta 199: 515-519, 1996), Wheat SPA (Albanietal, Plant Cell, 9: 171-184, 1997), sunflower oleosin (Cummins, et al., Plant Mol. Biol. 19: 873-876, 1992)], endosperm specific promoters [e.g., wheat LMW and HMW, glutenin-1 (Mol Gen Genet 216:81-90, 1989; NAR 17:461-2), wheat a, b and g gliadins (EMBO3:1409-15, 1984), Barley ltrl promoter, barley B1, C, D hordein (Theor Appl Gen 98:1253-62, 1999; Plant J 4:343-55, 1993; Mol Gen Genet 250:750-60, 1996), Barley DOF (Mena et al, The Plant Journal, 116(1): 53-62, 1998), Biz2 (EP99106056.7), Synthetic promoter (Vicente-Carbajosa et al., Plant J. 13: 629-640, 1998), rice prolamin NRP33, rice-globulin Glb-1 (Wu et al, Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorghum gamma-kafirin (PMB 32:1029-35, 1996)], embryo specific promoters [e.g., rice OSH1 (Sato et al, Proc. Nati. Acad. Sci. USA, 93: 8117-8122), KNOX (Postma-Haarsma of al, Plant Mol. Biol. 39:257-71, 1999), rice oleosin (Wu et at, J. Biochem., 123: 386, 1998)], and flower-specific promoters [e.g., AtPRP4, chalene synthase (chsA) (Van der Meer, et al., Plant Mol. Biol. 15, 95-109, 1990), LAT52 (Twell et al Mol. Gen Genet. 217:240-245; 1989), apetala-3].

Suitable abiotic stress-inducible promoters include, but not limited to, salt-inducible promoters such as RD29A (Yamaguchi-Shinozalei et al., Mol. Gen. Genet. 236:331-

340, 1993); drought-inducible promoters such as maize rab17 gene promoter (Pla et. al., Plant Mol. Biol. 21:259-266, 1993), maize rab28 gene promoter (Busk et. al., Plant J. 11:1285-1295, 1997) and maize Ivr2 gene promoter (Pelleschi et. al., Plant Mol. Biol. 39:373-380, 1999); heat-inducible promoters such as heat tomato hsp80-promoter from tomato (U.S. Pat. No. 5,187,267).

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338:274-276).

The principle methods of causing stable integration of exogenous DNA into plant genomic DNA include two main approaches:

(i) *Agrobacterium*-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S. and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Galon et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Tatlor, Eds. "Plant Virology Protocols: From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, N.Y., 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

Since processes which increase yield, growth rate, biomass, vigor, oil content, abiotic stress tolerance and/or nitrogen use efficiency of a plant can involve multiple genes acting additively or in synergy (see, for example, in Quesda et al., Plant Physiol. 130:951-063, 2002), the present invention also envisages expressing a plurality of exogenous polynucleotides in a single host plant to thereby achieve superior effect on the yield, growth rate, biomass, vigor, oil content, abiotic stress tolerance and/or nitrogen use efficiency of the plant.

Expressing a plurality of exogenous polynucleotides in a single host plant can be effected by co-introducing multiple nucleic acid constructs, each including a different exogenous polynucleotide, into a single plant cell. The transformed cell can than be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior yield, growth rate, biomass, vigor, oil content, abiotic stress tolerance and/or nitrogen use efficiency traits, using conventional plant breeding techniques.

According to some embodiments of the invention, the method further comprising growing the plant expressing the exogenous polynucleotide under the abiotic stress.

Non-limiting examples of abiotic stress conditions include, salinity, drought, water deprivation, excess of water (e.g., flood, waterlogging), etiolation, low temperature, high temperature, heavy metal toxicity, anaerobiosis, nutrient deficiency, nutrient excess, atmospheric pollution and UV irradiation.

Thus, the invention encompasses plants exogenously expressing the polynucleotide(s), the nucleic acid constructs and/or polypeptide(s) of the invention. Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immuno-assays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

In addition, the endogenous homolog of the exogenous polynucleotide or polypeptide of the invention, or a fragment of the endogenous homolog (e.g. introns or untranslated regions) in the plant can be used as a marker for marker assisted selection (MAS), in which a marker is used for indirect selection of a genetic determinant or determinants of a trait of interest (e.g., biomass, growth rate, oil content, yield, abiotic stress tolerance). These genes (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, polymorphism of the encoded polypeptide and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); selection for a biological trait (e.g., pathogen races or insect biotypes based on host pathogen or host parasite interaction can be used as a marker since the genetic constitution of an organism can affect its susceptibility to pathogens or parasites).

The polynucleotides and polypeptides described hereinabove can be used in a wide range of economical plants, in a safe and cost effective manner.

Plant lines exogenously expressing the polynucleotide or the polypeptide of the invention are screened to identify those that show the greatest increase of the desired plant trait.

The effect of the transgene (the exogenous polynucleotide encoding the polypeptide) on abiotic stress tolerance can be determined using known methods such as detailed below and in the Examples section which follows.

Abiotic stress tolerance—Transformed (i.e., expressing the transgene) and non-transformed (wild type) plants are exposed to an abiotic stress condition, such as water deprivation, suboptimal temperature (low temperature, high temperature), nutrient deficiency, nutrient excess, a salt stress condition, osmotic stress, heavy metal toxicity, anaerobiosis, atmospheric pollution and UV irradiation.

Salinity tolerance assay—Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution), or by culturing the plants in a hyperosmotic growth medium [e.g., 50% Murashige-Skoog medium (MS medium)]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 100 mM, 200 mM, 400 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of wilting and overall success to reach maturity and yield progeny are compared between control and transgenic plants.

Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic tolerance test—Osmotic stress assays (including sodium chloride and mannitol assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress germination experiments, the medium is supplemented for example with 50 mM, 100 mM, 200 mM NaCl or 100 mM, 200 mM NaCl, 400 mM mannitol.

Drought tolerance assay/Osmoticum assay—Tolerance to drought is performed to identify the genes conferring better plant survival after acute water deprivation. To analyze whether the transgenic plants are more tolerant to drought, an osmotic stress produced by the non-ionic osmolyte sorbitol in the medium can be performed. Control and transgenic plants are germinated and grown in plant-agar plates for 4 days, after which they are transferred to plates containing 500 mM sorbitol. The treatment causes growth retardation, then both control and transgenic plants are compared, by measuring plant weight (wet and dry), yield, and by growth rates measured as time to flowering.

Conversely, soil-based drought screens are performed with plants overexpressing the polynucleotides detailed above. Seeds from control *Arabidopsis* plants, or other transgenic plants overexpressing the polypeptide of the invention are germinated and transferred to pots. Drought stress is obtained after irrigation is ceased accompanied by placing the pots on absorbent paper to enhance the soil-drying rate. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

Cold stress tolerance—To analyze cold stress, mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between both control and transgenic plants, by measuring plant weight (wet and dry), and by comparing growth rates measured as time to flowering, plant size, yield, and the like.

Heat stress tolerance—Heat stress tolerance is achieved by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

Water use efficiency—can be determined as the biomass produced per unit transpiration. To analyze WUE, leaf relative water content can be measured in control and transgenic plants. Fresh weight (FW) is immediately recorded; then leaves are soaked for 8 hours in distilled water at room temperature in the dark, and the turgid weight (TW) is recorded. Total dry weight (DW) is recorded after drying the leaves at 60° C. to a constant weight. Relative water content (RWC) is calculated according to the following Formula I:

$$RWC=[(FW-DW)/(TW-DW)]\times 100 \qquad \text{Formula I}$$

Fertilizer use efficiency—To analyze whether the transgenic plants are more responsive to fertilizers, plants are grown in agar plates or pots with a limited amount of fertilizer, as described, for example, in Yanagisawa et al (Proc Natl Acad Sci USA. 2004; 101:7833-8). The plants are analyzed for their overall size, time to flowering, yield, protein content of shoot and/or grain. The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf verdure is highly correlated), amino acid and the total protein content of the seeds or other plant parts such as leaves or shoots, oil content, etc. Similarly, instead of providing nitrogen at limiting amounts, phosphate or potassium can be added at increasing concentrations. Again, the same parameters measured are the same as listed above. In this way, nitrogen use efficiency (NUE), phosphate use efficiency (PUE) and potassium use efficiency (KUE) are assessed, checking the ability of the transgenic plants to thrive under nutrient restraining conditions.

Nitrogen use efficiency—To analyze whether the transgenic *Arabidopsis* plants are more responsive to nitrogen, plant are grown in 0.75-1.5 mM (nitrogen deficient conditions) or 6-10 mM (optimal nitrogen concentration). Plants are allowed to grow for additional 20 days or until seed production. The plants are then analyzed for their overall size, time to flowering, yield, protein content of shoot and/or grain/seed production. The parameters checked can be the overall size of the plant, wet and dry weight, the weight of the seeds yielded, the average seed size and the number of seeds produced per plant. Other parameters that may be tested are: the chlorophyll content of leaves (as nitrogen plant status and the degree of leaf greenness is highly correlated), amino acid and the total protein content of the seeds or other plant parts such as leaves or shoots and oil content. Transformed plants not exhibiting substantial physiological and/or morphological effects, or exhibiting higher measured parameters levels than wild-type plants, are identified as nitrogen use efficient plants.

Nitrogen Use Efficiency assay using plantlets—The assay is done according to Yanagisawa-S. et al. with minor modifications ("Metabolic engineering with Dof1 transcription factor in plants: Improved nitrogen assimilation and growth under low-nitrogen conditions" *Proc. Natl. Acad. Sci. USA* 101, 7833-7838). Briefly, transgenic plants which are grown for 7-10 days in 0.5×MS [Murashige-Skoog] supplemented with a selection agent are transferred to two nitrogen-limiting conditions: MS media in which the combined nitrogen concentration ($NH_4NO_3$ and $KNO_3$) was 0.2 mM or 0.05 mM. Plants are allowed to grow for additional 30-40 days and then photographed, individually removed from the Agar (the shoot without the roots) and immediately weighed (fresh weight) for later statistical analysis. Constructs for which only T1 seeds are available are sown on selective media and at least 25 seedlings (each one representing an independent transformation event) are carefully transferred to the nitrogen-limiting media. For constructs for which T2 seeds are available, different transformation events are analyzed. Usually, 25 randomly selected plants from each event are transferred to the nitrogen-limiting media allowed to grow for 3-4 additional weeks and individually weighed at the end of that period. Transgenic plants are compared to control plants grown in parallel under the same conditions. Mock-transgenic plants expressing the uidA reporter gene (GUS) under the same promoter are used as control.

Nitrogen determination—The procedure for N (nitrogen) concentration determination in the structural parts of the plants involves the potassium persulfate digestion method to convert organic N to $NO_3^-$ (Purcell and King 1996 Argon. J. 88:111-113, the modified $Cd^-$ mediated reduction of $NO_3^-$ to $NO_2^-$ (Vodovotz 1996 Biotechniques 20:390-394) and the measurement of nitrite by the Griess assay (Vodovotz 1996, supra). The absorbance values are measured at 550 nm against a standard curve of $NaNO_2$. The procedure is described in details in Samonte et al. 2006 Agron. J. 98:168-176.

Germination tests—Germination tests compare the percentage of seeds from transgenic plants that could complete the germination process to the percentage of seeds from control plants that are treated in the same manner. Normal conditions are considered for example, incubations at 22° C. under 22-hour light 2-hour dark daily cycles. Evaluation of germination and seedling vigor is conducted between 4 and 14 days after planting. The basal media is 50% MS medium (Murashige and Skoog, 1962 Plant Physiology 15, 473-497).

Germination is checked also at unfavorable conditions such as cold (incubating at temperatures lower than 10° C. instead of 22° C.) or using seed inhibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl).

The effect of the transgene on plant's vigor, growth rate, biomass, yield and/or oil content can be determined using known methods.

Plant vigor—The plant vigor can be calculated by the increase in growth parameters such as leaf area, fiber length, rosette diameter, plant fresh weight and the like per time.

Growth rate—The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples.

Evaluation of growth rate can be done by measuring plant biomass produced, rosette area, leaf size or root length per time (can be measured in $cm^2$ per day of leaf area).

Relative growth rate area can be calculated using Formula II.

Relative growth area rate=Regression coefficient of area along time course.   Formula II:

Thus, the relative growth area rate is in units of 1/day and length growth rate is in units of 1/day.

Seed yield—Evaluation of the seed yield per plant can be done by measuring the amount (weight or size) or quantity (i.e., number) of dry seeds produced and harvested from 8-16 plants and divided by the number of plants.

For example, the total seeds from 8-16 plants can be collected, weighted using e.g., an analytical balance and the total weight can be divided by the number of plants. Seed yield per growing area can be calculated in the same manner while taking into account the growing area given to a single plant. Increase seed yield per growing area could be achieved by increasing seed yield per plant, and/or by increasing number of plants capable of growing in a given area.

In addition, seed yield can be determined via the weight of 1000 seeds. The weight of 1000 seeds can be determined as follows: seeds are scattered on a glass tray and a picture is taken. Each sample is weighted and then using the digital analysis, the number of seeds in each sample is calculated.

The 1000 seeds weight can be calculated using formula III:

1000 Seed Weight=number of seed in sample/sample weight×1000   Formula III:

The Harvest Index can be calculated using Formula IV

Harvest Index=Average seed yield per plant/Average dry weight   Formula IV:

Grain protein concentration—Grain protein content (g grain protein $m^{-2}$) is estimated as the product of the mass of grain N (g grain N $m^{-2}$) multiplied by the N/protein conversion ratio of k-5.13 (Mosse 1990, supra). The grain protein concentration is estimated as the ratio of grain protein content per unit mass of the grain (g grain protein $kg^{-1}$ grain).

Fiber length—Fiber length can be measured using fibrograph. The fibrograph system was used to compute length in terms of "Upper Half Mean" length. The upper half mean (UHM) is the average length of longer half of the fiber distribution. The fibrograph measures length in span lengths at a given percentage point (Hypertext Transfer Protocol://World Wide Web (dot) cottoninc (dot) com/ClassificationofCotton/?Pg=4#Length).

According to some embodiments of the invention, increased yield of corn may be manifested as one or more of the following: increase in the number of plants per growing area, increase in the number of ears per plant, increase in the number of rows per ear, number of kernels per ear row, kernel weight, thousand kernel weight (1000-weight), ear length/diameter, increase oil content per kernel and increase starch content per kernel.

As mentioned, the increase of plant yield can be determined by various parameters. For example, increased yield of rice may be manifested by an increase in one or more of the following: number of plants per growing area, number of panicles per plant, number of spikelets per panicle, number of flowers per panicle, increase in the seed filling rate, increase in thousand kernel weight (1000-weight), increase oil content per seed, increase starch content per seed, among others. An increase in yield may also result in modified architecture, or may occur because of modified architecture.

Similarly, increased yield of soybean may be manifested by an increase in one or more of the following: number of plants per growing area, number of pods per plant, number of seeds per pod, increase in the seed filling rate, increase in thousand seed weight (1000-weight), reduce pod shattering, increase oil content per seed, increase protein content per seed, among others. An increase in yield may also result in modified architecture, or may occur because of modified architecture.

Increased yield of canola may be manifested by an increase in one or more of the following: number of plants per growing area, number of pods per plant, number of seeds per pod, increase in the seed filling rate, increase in thousand seed weight (1000-weight), reduce pod shattering, increase oil content per seed, among others. An increase in yield may also result in modified architecture, or may occur because of modified architecture.

Increased yield of cotton may be manifested by an increase in one or more of the following: number of plants per growing area, number of bolls per plant, number of seeds per boll, increase in the seed filling rate, increase in thousand seed weight (1000-weight), increase oil content per seed, improve fiber length, fiber strength, among others. An increase in yield may also result in modified architecture, or may occur because of modified architecture.

Oil content—The oil content of a plant can be determined by extraction of the oil from the seed or the vegetative portion of the plant. Briefly, lipids (oil) can be removed from the plant (e.g., seed) by grinding the plant tissue in the presence of specific solvents (e.g., hexane or petroleum ether) and extracting the oil in a continuous extractor. Indirect oil content analysis can be carried out using various known methods such as Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)]; the Near Infrared (NI) Spectroscopy, which utilizes the absorption of near infrared energy (1100-2500 nm) by the sample; and a method described in WO/2001/023884, which is based on extracting oil a solvent, evaporating the solvent in a gas stream which forms oil particles, and directing a light into the gas stream and oil particles which forms a detectable reflected light.

Thus, the present invention is of high agricultural value for promoting the yield of commercially desired crops (e.g., biomass of vegetative organ such as poplar wood, or reproductive organ such as number of seeds or seed biomass).

Any of the transgenic plants described hereinabove or parts thereof may be processed to produce a feed, meal, protein or oil preparation, such as for ruminant animals.

The transgenic plants described hereinabove, which exhibit an increased oil content can be used to produce plant oil (by extracting the oil from the plant).

The plant oil (including the seed oil and/or the vegetative portion oil) produced according to the method of the invention may be combined with a variety of other ingredients. The specific ingredients included in a product are determined according to the intended use. Exemplary products include animal feed, raw material for chemical modification, biodegradable plastic, blended food product, edible oil, biofuel, cooking oil, lubricant, biodiesel, snack food, cosmetics, and fermentation process raw material. Exemplary products to be incorporated to the plant oil include animal feeds, human food products such as extruded snack foods, breads, as a food binding agent, aquaculture feeds, fermentable mixtures, food supplements, sport drinks, nutritional food bars, multi-vitamin supplements, diet drinks, and cereal foods.

According to some embodiments of the invention, the oil comprises a seed oil.

According to some embodiments of the invention, the oil comprises a vegetative portion oil.

According to some embodiments of the invention, the plant cell forms a part of a plant.

As used herein the term "about" refers to ±10%.

The terms "comprises", "comprising", "includes", "including", "having" and their conjugates mean "including but not limited to".

The term "consisting of means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible sub-ranges as well as individual numerical values within that range. For example, description of a range such as from 1 to 6 should be considered to have specifically disclosed sub-ranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

Example 1

Gene Identification and Gene Role Prediction Using Bioinformatics Tools

The present inventors have identified polynucleotides which can increase plant yield, seed yield, oil yield, oil content, biomass, growth rate, abiotic stress tolerance, nitrogen use efficiency and/or vigor of a plant, as follows.

The nucleotide sequence datasets used here were from publicly available databases or from sequences obtained using the Solexa technology (e.g. Barley and *Sorghum*). Sequence data from 100 different plant species was introduced into a single, comprehensive database. Other information on gene expression, protein annotation, enzymes and pathways were also incorporated. Major databases used include:

Genomes

*Arabidopsis* genome [TAIR genome version 6 (Hypertext Transfer Protocol://World Wide Web (dot) *arabidopsis* (dot) org/)];

Rice genome [IRGSP build 4.0 (Hypertext Transfer Protocol://rgp (dot) dna (dot) affrc (dot) go (dot) jp/IRGSP/)];

Poplar [Populus trichocarpa release 1.1 from JGI (assembly release v1.0) (Hypertext Transfer Protocol://World Wide Web (dot) genome (dot) jgi-psf (dot) org/)];

Brachypodium [JGI 4x assembly, Hypertext Transfer Protocol://World Wide Web (dot) brachpodium (dot) org)];

Soybean [DOE-JGI SCP, version GlymaO (Hypertext Transfer Protocol://World Wide Web (dot) phytozome (dot) net/)];

Grape [French-Italian Public Consortium for Grapevine Genome Characterization grapevine genome (Hypertext Transfer Protocol://World Wide Web (dot) genoscope (dot) cns (dot) fr /)];

Castobean [TIGR/J Craig Venter Institute 4x assembly [(Hypertext Transfer Protocol://msc (dot) jcvi (dot) org/r communis];

*Sorghum* [DOE-JGI SCP, version Sbi1 [Hypertext Transfer Protocol://World Wide Web (dot) phytozome (dot) net/)];

Partially assembled genome of Maize [Hypertext Transfer Protocol://maizesequence (dot) org/];

Expressed EST and mRNA Sequences Were Extracted from the Following Databases:

GenBank versions 154, 157, 160, 161, 164, 165, 166 and 168 (Hypertext Transfer Protocol://World Wide Web (dot) ncbi (dot) nlm (dot) nih (dot) gov/dbEST/);

RefSeq (Hypertext Transfer Protocol://World Wide Web (dot) ncbi (dot) nlm (dot) nih (dot) gov/RefSeq/);

TAIR (Hypertext Transfer Protocol://World Wide Web (dot) *arabidopsis* (dot) org/);

Protein and Pathway Databases

Uniprot [Hypertext Transfer Protocol://World Wide Web (dot) uniprot (dot) org/].

AraCyc [Hypertext Transfer Protocol://World Wide Web (dot) *arabidopsis* (dot) org/biocyc/index (dot) jsp].

ENZYME [Hypertext Transfer Protocol://expasy (dot) org/enzyme/].

Microarray Datasets were Downloaded from:

GEO (Hypertext Transfer Protocol://World Wide Web.ncbi.nlm.nih.gov/geo/) TAIR (Hypertext Transfer Protocol://World Wide Web.*arabidopsis*.org/).

Proprietary microarray data (See WO2008/122980 and Example 3 below).

QTL and SNPs Information

Gramene [Hypertext Transfer Protocol://World Wide Web (dot) gramene (dot) org/qtl/].

Panzea [Hypertext Transfer Protocol://World Wide Web (dot) panzea (dot) org/index (dot) html].

Database Assembly—was performed to build a wide, rich, reliable annotated and easy to analyze database comprised of publicly available genomic mRNA, ESTs DNA sequences, data from various crops as well as gene expression, protein annotation and pathway data QTLs, and other relevant information.

Database assembly is comprised of a toolbox of gene refining, structuring, annotation and analysis tools enabling to construct a tailored database for each gene discovery project. Gene refining and structuring tools enable to reliably detect splice variants and antisense transcripts, generating understanding of various potential phenotypic outcomes of a single gene. The capabilities of the "LEADS" platform of Compugen LTD for analyzing human genome have been confirmed and accepted by the scientific community [see e.g., "Widespread Antisense Transcription", Yelin, et al. (2003) Nature Biotechnology 21, 379-85; "Splicing of Alu Sequences", Lev-Maor, et al. (2003) Science 300 (5623), 1288-91; "Computational analysis of alternative splicing using EST tissue information", Xie H et al. Genomics 2002], and have been proven most efficient in plant genomics as well.

EST clustering and gene assembly—For gene clustering and assembly of organisms with available genome sequence data (*arabidopsis*, rice, castorbean, grape, brachypodium, poplar, soybean, *sorghum*) the genomic LEADS version (GANG) was employed. This tool allows most accurate clustering of ESTs and mRNA sequences on genome, and predicts gene structure as well as alternative splicing events and anti-sense transcription.

For organisms with no available full genome sequence data, "expressed LEADS" clustering software was applied.

Gene annotation—Predicted genes and proteins were annotated as follows:

Blast search [Hypertext Transfer Protocol://blast (dot) ncbi (dot) nlm (dot) nih (dot) gov /Blast (dot) cgi] against all plant UniProt [Hypertext Transfer Protocol://World Wide Web (dot) uniprot (dot) org/] sequences was performed. Open reading frames of each putative transcript were analyzed and longest ORF with higher number of homologues was selected as predicted protein of the transcript. The predicted proteins were analyzed by InterPro [Hypertext Transfer Protocol:// World Wide Web (dot) ebi (dot) ac (dot) uk/interpro/].

Blast against proteins from AraCyc and ENZYME databases was used to map the predicted transcripts to AraCyc pathways.

Predicted proteins from different species were compared using blast algorithm [Hypertext Transfer Protocol://World Wide Web (dot) ncbi (dot) nlm (dot) nih (dot) gov /Blast (dot) cgi] to validate the accuracy of the predicted protein sequence, and for efficient detection of orthologs.

Gene expression profiling—Several data sources were exploited for gene expression profiling which combined microarray data and digital expression profile (see below). According to gene expression profile, a correlation analysis was performed to identify genes which are co-regulated under different developmental stages and environmental conditions and which are associated with different phenotypes.

Publicly available microarray datasets were downloaded from TAIR and NCBI GEO sites, renormalized, and integrated into the database. Expression profiling is one of the most important resource data for identifying genes important for yield, biomass, growth rate, vigor, oil content, abiotic stress tolerance of plants and nitrogen use efficiency.

A digital expression profile summary was compiled for each cluster according to all keywords included in the sequence records comprising the cluster. Digital expression, also known as electronic Northern Blot, is a tool that displays virtual expression profile based on the EST sequences forming the gene cluster. The tool provides the expression profile of a cluster in terms of plant anatomy (e.g., the tissue/organ in which the gene is expressed), developmental stage (the developmental stages at which a gene can be found) and profile of treatment (provides the physiological conditions under which a gene is expressed such as drought, cold, pathogen infection, etc). Given a random distribution of ESTs in the different clusters, the digital expression provides a probability value that describes the probability of a cluster having a total of N ESTs to contain X ESTs from a certain collection of libraries. For the probability calculations, the following is taken into consideration: a) the number of ESTs in the cluster, b) the number of ESTs of the implicated and related libraries, c) the overall number of ESTs available representing the species. Thereby clusters with low probability values are highly enriched with ESTs from the group of libraries of interest indicating a specialized expression.

Recently, the accuracy of this system was demonstrated by Portnoy et al., 2009 (Analysis Of The Melon Fruit Transcriptome Based On 454 Pyrosequencing) in: Plant & Animal Genomes XVII Conference, San Diego, Calif. Transcriptomic analysis, based on relative EST abundance in data was performed by 454 pyrosequencing of cDNA representing mRNA of the melon fruit. Fourteen double strand cDNA samples obtained from two genotypes, two fruit tissues (flesh and rind) and four developmental stages were sequenced. GS FLX pyrosequencing (Roche/454 Life Sciences) of non-normalized and purified cDNA samples yielded 1,150,657 expressed sequence tags that assembled into 67,477 unigenes (32,357 singletons and 35,120 contigs). Analysis of the data obtained against the Cucurbit Genomics Database [Hypertext Transfer Protocol://World Wide Web (dot) icugi (dot) org/] confirmed the accuracy of the sequencing and assembly. Expression patterns of selected genes fitted well their qRT-PCR data.

Example 2

Production of *Arabidopsis* Transcription and High Throughput Correlation Analysis of Yirld, Biomass and/or Vigor Related Parameters using 44K *Arabidpsis* Full Genome Oligonucleotide Micro-Array To produce a high throughput correlation analysis, the present inventors utilized an *Arabidopsis thaliana* oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 40,000 *A. thaliana* genes and transcripts designed based on data from the TIGR ATH1 v.5 database and *Arabidopsis* MPSS (University of Delaware) databases. To define correlations between the levels of RNA expression and yield, biomass components or vigor related parameters, various plant characteristics of 15 different *Arabidopsis* ecotypes were analyzed. Among them, nine ecotypes encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

RNA extraction—Five tissues at different developmental stages including root, leaf, flower at anthesis, seed at 5 days after flowering (DAF) and seed at 12 DAF, representing different plant characteristics, were sampled and RNA was extracted using TRIzol Reagent from Invitrogen [Hypertext Transfer Protocol://World Wide Web (dot) invitrogen (dot) com/content (dot) cfm?pageid=469]. For convenience, each micro-array expression information tissue type has received a Set ID as summarized in Table 1 below.

TABLE 1

Tissues used for *Arabidopsis* transcriptom expression sets

| Expression Set | Set ID |
|---|---|
| Root | A |
| Leaf | B |
| Flower | C |
| Seed 5 DAF | D |
| Seed 12 DAF | E |

Table 1: Provided are the identification (ID) letters of each of the *Arabidopsis* expression sets (A-E). DAF = days after flowering.

Approximately 30-50 mg of tissue was taken from samples. The weighed tissues were ground using pestle and mortar in liquid nitrogen and resuspended in 500 µl of TRIzol Reagent. To the homogenized lysate, 100 µl of chloroform was added followed by precipitation using isopropanol and two washes with 75% ethanol. The RNA was eluted in 30 µl of RNase-free water. RNA samples were cleaned up using Qiagen's RNeasy minikit clean-up protocol as per the manufacturer's protocol.

Yield components and vigor related parameters assessment—eight out of the nine *Arabidopsis* ecotypes were used in each of 5 repetitive blocks (named A, B, C, D and E), each containing 20 plants per plot. The plants were grown in a greenhouse at controlled conditions in 22° C., and the N:P:K fertilizer (20:20:20; weight ratios) [nitrogen (N), phosphorus (P) and potassium (K)] was added. During this time data was collected, documented and analyzed. Additional data was collected through the seedling stage of plants grown in a tissue culture in vertical grown transparent agar plates. Most of chosen parameters were analyzed by digital imaging.

Digital imaging in Tissue culture—A laboratory image acquisition system was used for capturing images of plantlets sawn in square agar plates. The image acquisition system consists of a digital reflex camera (Canon EOS 300D) attached to a 55 mm focal length lens (Canon EF-S series), mounted on a reproduction device (Kaiser RS), which included 4 light units (4×150 Watts light bulb) and located in a darkroom.

Digital imaging in Greenhouse—The image capturing process was repeated every 3-4 days starting at day 7 till day 30. The same camera attached to a 24 mm focal length lens (Canon EF series), placed in a custom made iron mount, was used for capturing images of larger plants sawn in white tubs in an environmental controlled greenhouse. The white tubs were square shape with measurements of 36×26.2 cm and 7.5 cm deep. During the capture process, the tubs were placed beneath the iron mount, while avoiding direct sun light and casting of shadows. This process was repeated every 3-4 days for up to 30 days.

An image analysis system was used, which consists of a personal desktop computer (Intel P4 3.0 GHz processor) and a public domain program—ImageJ 1.37, Java based image processing program, which was developed at the U.S National Institutes of Health and is freely available on the internet at Hypertext Transfer Protocol://rsbweb (dot) nih (dot) gov/. Images were captured in resolution of 6 Mega Pixels (3072×2048 pixels) and stored in a low compression JPEG (Joint Photographic Experts Group standard) format.

Next, analyzed data was saved to text files and processed using the JMP statistical analysis software (SAS institute).

Leaf analysis—Using the digital analysis leaves data was calculated, including leaf number, area, perimeter, length and width. On day 30, 3-4 representative plants were chosen from each plot of blocks A, B and C. The plants were dissected, each leaf was separated and was introduced between two glass trays, a photo of each plant was taken and the various parameters (such as leaf total area, laminar length etc.) were calculated from the images. The blade circularity was calculated as laminar width divided by laminar length.

Root analysis—During 17 days, the different ecotypes were grown in transparent agar plates. The plates were photographed every 3 days starting at day 7 in the photography room and the roots development was documented (see examples in FIGS. 3A-F). The growth rate of roots was calculated according to Formula V.

Relative growth rate of root coverage=Regression coefficient of root coverage along time course.     Formula V:

Vegetative growth rate analysis—was calculated according to Formula VI. The analysis was ended with the appearance of overlapping plants.

Relative vegetative growth rate area=Regression coefficient of vegetative area along time course.

For comparison between ecotypes the calculated rate was normalized using plant developmental stage as represented by the number of true leaves. In cases where plants with 8 leaves had been sampled twice (for example at day 10 and day 13), only the largest sample was chosen and added to the Anova comparison.

Seeds in siliques analysis—On day 70, 15-17 siliques were collected from each plot in blocks D and E. The chosen siliques were light brown color but still intact. The siliques were opened in the photography room and the seeds were scatter on a glass tray, a high resolution digital picture was taken for each plot. Using the images the number of seeds per silique was determined.

Seeds average weight—At the end of the experiment all seeds from plots of blocks A-C were collected. An average weight of 0.02 grams was measured from each sample, the seeds were scattered on a glass tray and a picture was taken. Using the digital analysis, the number of seeds in each sample was calculated.

Oil percentage in seeds—At the end of the experiment all seeds from plots of blocks A-C were collected. Columbia seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingler's) 1879, 232, 461) was used to create a calibration curve for the Low Resonance NMR. The content of oil of all seed samples was determined using the Low Resonance NMR (MARAN Ultra—Oxford Instrument) and its MultiQuant sowftware package.

Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Dry weight and seed yield—On day 80 from sowing, the plants from blocks A-C were harvested and left to dry at 30°

C. in a drying chamber. The biomass and seed weight of each plot was separated, measured and divided by the number of plants. Dry weight=total weight of the vegetative portion above ground (excluding roots) after drying at 30° C. in a drying chamber; Seed yield per plant=total seed weight per plant (gr).

Oil yield—The oil yield was calculated using Formula VII.

Seed Oil yield=Seed yield per plant (gr)*Oil % in seed   Formula VII:

Harvest Index—The harvest index was calculated using Formula IV as described above [Harvest Index=Average seed yield per plant/Average dry weight].

Experimental Results

Nine different Arabidopsis ecotypes were grown and characterized for 18 parameters (named as vectors). Data parameters are summarized in Table 2, below.

TABLE 2

| Arabidopsis correlated parameters (vectors) | |
|---|---|
| Correlated parameter with | Correlation ID |
| Root length day 13 (cm) | 1 |
| Root length day 7 (cm) | 2 |
| Relative root growth (cm/day) day 13 | 3 |
| Fresh weight per plant (gr) at bolting stage | 4 |
| Dry matter per plant (gr) | 5 |
| Vegetative growth rate (cm$^2$/day) till 8 true leaves | 6 |
| Blade circularity | 7 |
| Lamina width (cm) | 8 |
| Lamina length (cm) | 9 |
| Total leaf area per plant (cm) | 10 |
| 1000 Seed weight (gr) | 11 |
| Oil % per seed | 12 |
| Seeds per silique | 13 |
| Silique length (cm) | 14 |
| Seed yield per plant (gr) | 15 |
| Oil yield per plant (mg) | 16 |
| Harvest Index | 17 |
| Leaf width/length | 18 |

Table 2. Provided are the Arabidopsis correlated parameters (correlation ID Nos. 1-18). Abbreviations: Cm = centimeter(s); gr = gram(s); mg = milligram(s).

The characterized values are summarized in Tables 3 and 4 below.

TABLE 3

Measured parameters in Arabidopsis ecotypes

| Ecotype | Seed yield per plant (gr) | Oil yield per plant (mg) | Oil % per seed | 1000 Seed weight (gr) | Dry matter per plant (gr) | Harvest Index | Total leaf area per plant (cm) | Seeds per silique | Silique length (cm) |
|---|---|---|---|---|---|---|---|---|---|
| An-1 | 0.34 | 118.63 | 34.42 | 0.0203 | 0.64 | 0.53 | 46.86 | 45.44 | 1.06 |
| Col-0 | 0.44 | 138.73 | 31.19 | 0.0230 | 1.27 | 0.35 | 109.89 | 53.47 | 1.26 |
| Ct-1 | 0.59 | 224.06 | 38.05 | 0.0252 | 1.05 | 0.56 | 58.36 | 58.47 | 1.31 |
| Cvi (N8580) | 0.42 | 116.26 | 27.76 | 0.0344 | 1.28 | 0.33 | 56.80 | 35.27 | 1.47 |
| Gr-6 | 0.61 | 218.27 | 35.49 | 0.0202 | 1.69 | 0.37 | 114.66 | 48.56 | 1.24 |
| Kondara | 0.43 | 142.11 | 32.91 | 0.0263 | 1.34 | 0.32 | 110.82 | 37.00 | 1.09 |
| Ler-1 | 0.36 | 114.15 | 31.56 | 0.0205 | 0.81 | 0.45 | 88.49 | 39.38 | 1.18 |
| Mt-0 | 0.62 | 190.06 | 30.79 | 0.0226 | 1.21 | 0.51 | 121.79 | 40.53 | 1.18 |
| Shakdara | 0.55 | 187.62 | 34.02 | 0.0235 | 1.35 | 0.41 | 93.04 | 25.53 | 1.00 |

Table 3. Provided are the values of each of the parameters measured in Arabidopsis ecotypes: Seed yield per plant (gram); oil yield per plant (mg); oil % per seed; 1000 seed weight (gr); dry matter per plant (gr); harvest index; total leaf area per plant (cm); seeds per silique; Silique length (cm).

TABLE 4

Additional measured parameters in Arabidopsis ecotypes

| Ecotype | Veg. GR | Relat. root growth | Root length day 7 | Root length day 13 | Fresh weight per plant | Lam. Leng. | Lam. width | Leaf width/ length | Blade circularity |
|---|---|---|---|---|---|---|---|---|---|
| An-1 | 0.313 | 0.631 | 0.937 | 4.419 | 1.510 | 2.767 | 1.385 | 0.353 | 0.509 |
| Col-0 | 0.378 | 0.664 | 1.759 | 8.530 | 3.607 | 3.544 | 1.697 | 0.288 | 0.481 |
| Ct-1 | 0.484 | 1.176 | 0.701 | 5.621 | 1.935 | 3.274 | 1.460 | 0.316 | 0.450 |
| Cvi (N8580) | 0.474 | 1.089 | 0.728 | 4.834 | 2.082 | 3.785 | 1.374 | 0.258 | 0.370 |
| Gr-6 | 0.425 | 0.907 | 0.991 | 5.957 | 3.556 | 3.690 | 1.828 | 0.356 | 0.501 |
| Kondara | 0.645 | 0.774 | 1.163 | 6.372 | 4.338 | 4.597 | 1.650 | 0.273 | 0.376 |
| Ler-1 | 0.430 | 0.606 | 1.284 | 5.649 | 3.467 | 3.877 | 1.510 | 0.305 | 0.394 |

TABLE 4-continued

Additional measured parameters in *Arabidopsis* ecotypes

| Ecotype | Veg. GR | Relat. root growth | Root length day 7 | Root length day 13 | Fresh weight per plant | Lam. Leng. | Lam. width | Leaf width/ length | Blade circularity |
|---|---|---|---|---|---|---|---|---|---|
| Mt-0 | 0.384 | 0.701 | 1.414 | 7.060 | 3.479 | 3.717 | 1.817 | 0.335 | 0.491 |
| Shakdara | 0.471 | 0.782 | 1.251 | 7.041 | 3.710 | 4.149 | 1.668 | 0.307 | 0.409 |

Table 4. Provided are the values of each of the parameters measured in *Arabidopsis* ecotypes: Veg. GR = vegetative growth rate (cm²/day) until 8 true leaves; Relat. Root growth = relative root growth (cm/day); Root length day 7 (cm); Root length day 13 (cm); fresh weight per plant (gr) at bolting stage; Lam. Leng. = Lamima length (cm); Lam. Width = Lamina width (cm); Leaf width/length; Blade circularity.

Tables 5-7, below, provide the selected genes, the characterized parameters (which are used as x axis for correlation) and the correlated tissue transcriptom along with the correlation value (R, calculated using Pearson correlation). When the correlation coefficient (R) between the levels of a gene's expression in a certain tissue and a phenotypic performance across ecotypes is high in absolute value (between 0.5-1), there is an association between the gene (specifically the expression level of this gene) and the phenotypic character. A positive correlation indicates that the expression of the gene in a certain tissue or developmental stage and the correlation vector (phenotype performance) are positively associated (both, expression and phenotypic performance increase or decrease simultaneously) while a negative correlation indicates a negative association (while the one is increasing the other is decreasing and vice versa).

TABLE 5

Correlation between the expression level of selected genes in specific tissues or developmental stages and the phenotypic performance across *Arabidopsis* ecotypes

| Gene Name | Corr. Vec. | Exp. Set | R | Corr. Vec. | Exp. Set | R | Corr. Vec. | Exp. Set | R |
|---|---|---|---|---|---|---|---|---|---|
| BDL117 | 1 | C | −0.907 | 1 | A | −0.809 | 13 | D | 0.961 |
| BDL118 | 13 | A | 0.817 | 6 | A | 0.805 | 5 | D | −0.821 |
| BDL118 | 17 | D | 0.958 | 17 | D | 0.834 | 8 | D | −0.833 |
| BDL118 | 8 | D | −0.845 | 10 | D | −0.912 | 10 | D | −0.975 |
| BDL118 | 4 | D | −0.904 | | | | | | |
| BDL126 | 5 | B | 0.942 | | | | | | |
| BDL138 | 16 | C | 0.841 | 15 | C | 0.813 | 16 | B | 0.878 |
| BDL138 | 15 | B | 0.896 | 13 | A | 0.94 | | | |
| BDL140 | 14 | C | 0.841 | 3 | C | 0.821 | 11 | C | 0.855 |
| BDL140 | 14 | B | 0.836 | 11 | B | 0.855 | 7 | E | −0.812 |
| BDL140 | 6 | E | 0.889 | 13 | D | 0.826 | 14 | D | 0.862 |
| BDL147 | 16 | B | 0.948 | 15 | B | 0.898 | | | |
| BDL149 | 14 | B | 0.83 | 3 | B | 0.891 | 14 | A | 0.951 |
| BDL152 | 16 | D | 0.969 | 3 | D | 0.855 | 15 | D | 0.987 |
| BDL153 | 14 | C | 0.836 | 11 | C | 0.823 | 14 | A | −0.862 |
| BDL153 | 11 | A | 0.88 | 8 | D | −0.81 | | | |
| BDL154 | 11 | C | 0.874 | | | | | | |
| BDL155 | 16 | B | 0.829 | 16 | A | 0.86 | | | |
| BDL156 | 3 | C | 0.923 | 14 | B | 0.901 | | | |
| BDL157 | 3 | B | 0.854 | 2 | B | −0.825 | 5 | D | −0.803 |
| BDL157 | 17 | D | 0.923 | 9 | D | −0.809 | 8 | D | −0.834 |
| BDL157 | 10 | D | −0.915 | 4 | D | −0.89 | | | |
| BDL158 | 8 | B | 0.953 | 10 | B | 0.945 | 4 | B | 0.899 |
| BDL158 | 11 | A | −0.833 | | | | | | |
| BDL160 | 7 | C | 0.82 | 18 | C | 0.972 | 8 | A | 0.918 |
| BDL160 | 8 | A | 0.839 | 8 | A | 0.834 | 10 | A | 0.93 |
| BDL160 | 10 | A | 0.93 | 4 | A | 0.862 | 1 | E | 0.864 |
| BDL160 | 1 | E | 0.841 | 2 | E | 0.861 | 2 | E | 0.839 |
| BDL160 | 8 | D | 0.867 | 8 | D | 0.811 | 10 | D | 0.824 |
| BDL162 | 5 | B | 0.89 | | | | | | |
| BDL163 | 16 | B | 0.925 | 15 | B | 0.884 | 18 | E | 0.828 |
| BDL165 | 8 | B | 0.952 | 10 | B | 0.902 | 4 | B | 0.821 |
| BDL165 | 8 | E | 0.807 | 15 | E | 0.816 | 11 | D | 0.846 |
| BDL167 | 16 | B | 0.899 | 15 | B | 0.946 | 17 | D | 0.859 |
| BDL167 | 2 | D | −0.806 | | | | | | |
| BDL168 | 16 | C | 0.97 | 15 | C | 0.929 | 8 | B | 0.931 |
| BDL168 | 10 | B | 0.88 | 13 | A | −0.835 | 5 | D | −0.911 |
| BDL168 | 8 | D | −0.946 | 10 | D | −0.849 | | | |
| BDL169 | 14 | B | −0.82 | 11 | B | −0.848 | 12 | A | 0.901 |
| BDL171 | 14 | C | −0.842 | 2 | B | −0.844 | 5 | A | 0.803 |
| BDL171 | 1 | A | −0.851 | 2 | A | −0.821 | 5 | D | −0.827 |
| BDL171 | 17 | D | 0.958 | 17 | D | 0.853 | 17 | D | 0.825 |
| BDL171 | 9 | D | −0.82 | 8 | D | −0.87 | 16 | D | 0.857 |
| BDL171 | 10 | D | −0.901 | 10 | D | −0.948 | 4 | D | −0.808 |
| BDL171 | 4 | D | −0.932 | 15 | D | 0.838 | | | |

TABLE 5-continued

Correlation between the expression level of selected genes in specific tissues or developmental stages and the phenotypic performance across *Arabidopsis* ecotypes

| Gene Name | Corr. Vec. | Exp. Set | R | Corr. Vec. | Exp. Set | R | Corr. Vec. | Exp. Set | R |
|---|---|---|---|---|---|---|---|---|---|
| BDL173 | 7 | B | 0.892 | 9 | B | −0.874 | 18 | B | 0.816 |
| BDL173 | 17 | D | 0.948 | 8 | D | −0.888 | 10 | D | −0.974 |
| BDL173 | 4 | D | −0.871 | | | | | | |
| BDL174 | 17 | C | 0.901 | 5 | D | −0.917 | 8 | D | −0.879 |
| BDL174 | 10 | D | −0.85 | | | | | | |
| BDL176 | 5 | D | −0.907 | 8 | D | −0.913 | 13 | D | 0.93 |
| BDL177 | 17 | C | 0.919 | 17 | B | 0.91 | 17 | D | 0.82 |
| BDL181 | 16 | C | 0.893 | 15 | C | 0.838 | 8 | B | 0.816 |
| BDL181 | 12 | A | 0.931 | 16 | A | 0.823 | 18 | E | 0.819 |
| BDL181 | 16 | D | 0.865 | 15 | D | 0.856 | | | |
| BDL182 | 12 | A | 0.913 | 12 | D | 0.825 | | | |
| BDL183 | 16 | B | 0.915 | 15 | B | 0.898 | | | |
| BDL186 | 12 | B | 0.944 | 11 | B | 0.833 | 8 | D | −0.807 |
| BDL187 | 16 | B | 0.908 | 15 | B | 0.835 | 5 | D | −0.803 |
| BDL187 | 8 | D | −0.892 | | | | | | |
| BDL188 | 14 | B | 0.904 | 12 | D | 0.964 | 3 | D | 0.857 |
| BDL188 | 2 | D | −0.886 | | | | | | |
| BDL189 | 16 | B | 0.951 | 15 | B | 0.907 | 6 | E | −0.854 |
| BDL189 | 8 | D | −0.821 | 1 | D | −0.938 | | | |
| BDL190 | 16 | B | 0.857 | 15 | B | 0.91 | 7 | E | −0.865 |
| BDL192 | 7 | B | 0.907 | 9 | B | −0.806 | 17 | D | 0.91 |
| BDL192 | 10 | D | −0.907 | 4 | D | −0.94 | 2 | D | −0.82 |
| BDL193 | 8 | C | 0.846 | 12 | B | 0.904 | 11 | B | 0.876 |
| BDL193 | 11 | A | 0.885 | 11 | E | 0.923 | 5 | D | −0.801 |
| BDL193 | 8 | D | −0.802 | 8 | D | −0.844 | 10 | D | −0.806 |
| BDL194 | 12 | B | 0.933 | 18 | D | 0.877 | | | |
| BDL196 | 16 | D | 0.917 | 15 | D | 0.937 | | | |
| BDL197 | 13 | A | 0.91 | 8 | D | 0.837 | | | |
| BDL200 | 2 | C | 0.818 | 16 | B | 0.864 | 15 | B | 0.832 |
| BDL200 | 14 | A | 0.917 | 1 | E | 0.815 | 3 | D | 0.851 |
| BDL201 | 9 | C | 0.846 | 5 | D | 0.916 | 17 | D | −0.906 |
| BDL201 | 8 | D | 0.954 | 10 | D | 0.947 | 4 | D | 0.865 |
| BDL203 | 10 | B | 0.926 | 4 | B | 0.893 | 14 | A | −0.828 |
| BDL219 | 1 | A | 0.879 | 2 | A | 0.821 | 9 | E | −0.801 |
| BDL220 | 8 | B | 0.822 | 10 | B | 0.844 | 4 | B | 0.839 |
| BDL221 | 12 | C | 0.897 | 16 | C | 0.917 | 15 | C | 0.814 |
| BDL221 | 3 | B | 0.936 | 9 | D | −0.936 | 6 | D | −0.897 |
| BDL221 | 4 | D | −0.808 | | | | | | |
| BDL222 | 1 | B | 0.829 | 2 | B | 0.887 | 1 | A | 0.875 |
| BDL222 | 2 | A | 0.849 | 2 | D | 0.925 | | | |
| BDL223 | 14 | C | 0.93 | 14 | B | 0.835 | 3 | B | 0.851 |
| BDL223 | 14 | A | 0.831 | | | | | | |
| BDL224 | 5 | E | −0.826 | 9 | E | −0.872 | | | |
| BDL225 | 7 | C | 0.833 | 15 | B | −0.806 | 13 | A | −0.836 |
| BDL227 | 2 | A | −0.931 | | | | | | |
| BDL229 | 10 | B | 0.858 | 2 | D | 0.832 | | | |
| BDL231 | 16 | B | 0.911 | 15 | B | 0.869 | 11 | D | 0.88 |
| BDL233 | 14 | C | −0.885 | | | | | | |
| BDL235 | 11 | E | 0.808 | 12 | D | 0.818 | 2 | D | −0.887 |
| BDL240 | 1 | D | −0.808 | | | | | | |
| BDL241 | 13 | A | −0.88 | | | | | | |
| BDL242 | 11 | B | 0.889 | | | | | | |
| BDL243 | 11 | B | 0.929 | | | | | | |
| BDL245 | 3 | A | −0.863 | 11 | A | −0.832 | 16 | D | −0.806 |
| BDL247 | 16 | B | 0.816 | | | | | | |
| BDL248 | 13 | A | −0.829 | | | | | | |
| BDL249 | 8 | C | −0.84 | 16 | E | −0.808 | 15 | E | −0.892 |
| BDL250 | 9 | A | −0.805 | 2 | E | −0.85 | 17 | D | 0.815 |
| BDL250 | 10 | D | −0.809 | 4 | D | −0.804 | 1 | D | −0.9 |
| BDL251 | 18 | C | 0.802 | 7 | D | −0.861 | | | |
| BDL47 | 8 | B | 0.845 | | | | | | |
| BDL49 | 7 | E | 0.805 | 9 | E | −0.883 | 6 | E | −0.809 |
| BDL62 | 18 | A | 0.862 | 6 | E | −0.869 | 13 | D | 0.829 |
| BDL75 | 11 | C | 0.816 | 5 | B | 0.945 | 8 | B | 0.823 |
| BDL79 | 7 | B | 0.876 | 18 | B | 0.841 | 12 | D | 0.884 |
| BDL79 | 2 | D | −0.938 | | | | | | |
| BDL81 | 8 | C | 0.897 | 12 | B | 0.803 | 1 | D | −0.81 |
| BDL81 | 2 | D | −0.86 | | | | | | |

TABLE 5-continued

Correlation between the expression level of selected genes in specific tissues or developmental stages and the phenotypic performance across Arabidopsis ecotypes

| Gene Name | Corr. Vec. | Exp. Set | R | Corr. Vec. | Exp. Set | R | Corr. Vec. | Exp. Set | R |
|---|---|---|---|---|---|---|---|---|---|
| BDL83 | 3 | C | −0.861 | 2 | C | 0.905 | | | |
| BDL85 | 8 | D | 0.82 | | | | | | |

Table 5. Provided are the correlations between the expression level of selected genes in specific tissues or developmental stages (expression sets) and the phenotypic performance (correlation vector) across Arabidopsis ecotypes.
The phenotypic characters [correlation (Corr.) vector (Vec.)] include yield (seed yield, oil yield, oil content), biomass, growth rate and/or vigor omponents as described in Tables 2, 3 and 4.
Exp. Set = expression set according to Table 1 hereinabove.

Table 6 hereinbelow provides data about the homologous of selected genes, the characterized parameters (which are used as x axis for correlation) and the correlated tissue transcriptom along with the correlation value (R, calculated using Pearson correlation).

TABLE 6

Correlation between the expression level of homologous of the selected genes in specific tissues or developmental stages and the phenotypic performance across Arabidopsis ecotypes

| Gene Name | Exp. Set | Corr. Vec. | R |
|---|---|---|---|
| BDL155 H1 | leaf | relative root growth | 0.814 |
| BDL155 H1 | seed5daf | Silique length | −0.855 |
| BDL171 H0 | leaf | Leaf width/length | 0.835 |
| BDL171 H0 | seed5daf | Dry matter per plant | −0.82 |
| BDL171 H0 | seed5daf | Lamina width | −0.813 |
| BDL183 H0 | seed12daf | Blade circularity | −0.878 |
| BDL231 H0 | flower | seed weight | 0.825 |
| BDL231 H0 | leaf | Silique length | 0.816 |
| BDL231 H0 | leaf | relative root growth | 0.854 |
| BDL231 H0 | root | seed weight | 0.92 |
| BDL248 H0 | seed5daf | relative root growth | 0.851 |
| BDL70 H0 | seed12daf | Lamina length | −0.816 |
| BDL70 H0 | seed5daf | seed yield per plant | −0.82 |

Table 6. Provided are the correlations between the expression levels of homologues of selected Arabidopsis genes in various tissues or developmental stages (Expression sets) and the phenotypic performance in various yield (seed yield, oil yield, oil content), biomass, growth rate and/or vigor components [Correlation (Corr.) vector (Vec.)]
Corr. Vec. = correlation vector specified in Tables 2, 3 and 4;
Exp. Set = expression set specified in Table 1.

Example 3

Production of Arabidopsis Transcription and High Throughput Correlation Analysis of Normal and Nitrogen Limiting Conditions using 44K Arabidopsis Oligonucleotide Micro-Array In order to produce a high throughput correlation analysis, the present inventors utilized a Arabidopsis oligonucleotide micro-array, produced by Agilent Technologies [Hypertext Transfer Protocol://World Wide Web (dot) chem (dot) agilent (dot) com/Scripts/PDS (dot) asp?1Page=50879]. The array oligonucleotide represents about 44,000 Arabidopsis genes and transcripts. To define correlations between the levels of RNA expression with NUE, yield components or vigor related parameters various plant characteristics of 14 different Arabidopsis ecotypes were analyzed. Among them, ten ecotypes encompassing the observed variance were selected for RNA expression analysis. The correlation between the RNA levels and the characterized parameters was analyzed using Pearson correlation test [Hypertext Transfer Protocol:// World Wide Web (dot) davidmlane (dot) com/hyperstat/ A34739 (dot) html].

Experimental Procedures

RNA extraction—Two tissues of plants [leaves and stems] growing at two different nitrogen fertilization levels (1.5 mM Nitrogen or 6 mM Nitrogen) were sampled and RNA was extracted using TRIzol Reagent from Invitrogen [Hypertext Transfer Protocol://World Wide Web (dot) invitrogen (dot) com/content (dot)cfm?pageid=469]. For convenience, each micro-array expression information tissue type has received a Set ID as summarized in Table 7 below.

TABLE 7

Tissues used for Arabidopsis transcriptom expression sets

| Expression Set | Set ID |
|---|---|
| Leaves at 1.5 mM Nitrogen fertilization | A |
| Leaves at 6 mM Nitrogen fertilization | B |
| Stems at 1.5 mM Nitrogen fertilization | C |
| Stem at 6 mM Nitrogen fertilization | D |

Table 7: Provided are the identification (ID) letters of each of the Arabidopsis expression sets.

Approximately 30-50 mg of tissue was taken from samples. The weighed tissues were ground using pestle and mortar in liquid nitrogen and resuspended in 500 µl of TRIzol Reagent. To the homogenized lysate, 100 µl of chloroform was added followed by precipitation using isopropanol and two washes with 75% ethanol. The RNA was eluted in 30 µl of RNase-free water. RNA samples were cleaned up using Qiagen's RNeasy minikit clean-up protocol as per the manufacturer's protocol (QIAGEN Inc, CA USA).

Assessment of Arabidopsis yield components and vigor related parameters under different nitrogen fertilization levels—10 Arabidopsis accessions in 2 repetitive plots each containing 8 plants per plot were grown at greenhouse. The growing protocol used was as follows: surface sterilized seeds were sown in Eppendorf tubes containing 0.5× Murashige-Skoog basal salt medium and grown at 23° C. under 12-hour light and 12-hour dark daily cycles for 10 days. Then, seedlings of similar size were carefully transferred to pots filled with a mix of perlite and peat in a 1:1 ratio. Constant nitrogen limiting conditions were achieved by irrigating the plants with a solution containing 1.5 mM inorganic nitrogen in the form of $KNO_3$, supplemented with 2 mM $CaCl_2$, 1.25 mM $KH_2PO_4$, 1.50 mM $MgSO_4$, 5 mM KCl, 0.01 mM $H_3BO_3$ and microelements, while normal irrigation conditions (Normal Nitrogen conditions) was achieved by applying a solution of 6 mM inorganic nitrogen also in the form of $KNO_3$, supplemented with 2 mM $CaCl_2$, 1.25 mM $KH_2PO_4$, 1.50 mM $MgSO_4$, 0.01 mM $H_3BO_3$ and microelements. To follow plant growth, trays were photographed the day nitrogen limiting conditions were initiated and subsequently every 3 days for about 15 additional days. Rosette plant area was then determined from the digital pictures. ImageJ software was used for quantifying the plant size from the digital pictures [Hypertext Transfer Protocol://rsb (dot) info (dot) nih (dot) gov/ij/] utilizing proprietary scripts designed to analyze the size of rosette area from individual plants as a function of time. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb (dot) nih (dot) gov/]. Next, analyzed data was saved to text files and processed using the JMP statistical analysis software (SAS institute).

Data parameters collected are summarized in Table 8, hereinbelow.

TABLE 8

*Arabidopsis* correlated parameters (vectors)

| Correlated parameter with | Correlation Id |
|---|---|
| N 1.5 mM; Rosette Area at day 8 [cm$^2$] | 1 |
| N 1.5 mM; Rosette Area at day 10 [cm$^2$] | 2 |
| N 1.5 mM; Plot Coverage at day 8 [%] | 3 |
| N 1.5 mM; Plot Coverage at day 10 [%] | 4 |
| N 1.5 mM; Leaf Number at day 10 | 5 |
| N 1.5 mM; Leaf Blade Area at day 10 [cm$^2$] | 6 |
| N 1.5 mM; RGR of Rosette Area at day 3 [cm$^2$/day] | 7 |
| N 1.5 mM; t50 Flowering [day] | 8 |
| N 1.5 mM; Dry Weight [gr/plant] | 9 |
| N 1.5 mM; Seed Yield [gr/plant] | 10 |
| N 1.5 mM; Harvest Index | 11 |
| N 1.5 mM; 1000 Seeds weight [gr] | 12 |
| N 1.5 mM; seed yield/rosette area at day 10 [gr/cm$^2$] | 13 |
| N 1.5 mM; seed yield/leaf blade [gr/cm$^2$] | 14 |
| N 1.5 mM; % Seed yield reduction compared to N 6 mM | 15 |
| N 1.5 mM; % Biomass reduction compared to N 6 mM | 16 |
| N 1.5 mM; N level/DW [SPAD unit/gr] | 17 |
| N 1.5 mM; DW/N level [gr/SPAD unit] | 18 |
| N 1.5 mM; seed yield/N level [gr/SPAD unit] | 19 |
| N 6 mM; Rosette Area at day 8 [cm$^2$] | 20 |
| N 6 mM; Rosette Area at day 10 [cm$^2$] | 21 |
| N 6 mM; Plot Coverage at day 8 [%] | 22 |
| N 6 mM; Plot Coverage at day 10 [%] | 23 |
| N 6 mM; Leaf Number at day 10 | 24 |
| N 6 mM; Leaf Blade Area at day 10 | 25 |
| N 6 mM; RGR of Rosette Area at day 3 [cm$^2$/gr] | 26 |
| N 6 mM; t50 Flowering [day] | 27 |
| N 6 mM; Dry Weight [gr/plant] | 28 |
| N 6 mM; Seed Yield [gr/plant] | 29 |
| N 6 mM; Harvest Index | 30 |
| N 6 mM; 1000 Seeds weight [gr] | 31 |
| N 6 mM; seed yield/rosette area day at day 10 [gr/cm$^2$] | 32 |
| N 6 mM; seed yield/leaf blade [gr/cm$^2$] | 33 |
| N 6 mM; N level/FW | 34 |
| N 6 mM; DW/N level [gr/SPAD unit] | 35 |
| N 6 mM; N level/DW (SPAD unit/gr plant) | 36 |
| N 6 mM; Seed yield/N unit [gr/SPAD unit] | 37 |

Table 8. Provided are the *Arabidopsis* correlated parameters (vectors).
"N" = Nitrogen at the noted concentrations;
"gr." = grams;
"SPAD" = chlorophyll levels;
"t50" = time where 50% of plants flowered;
"gr/SPAD unit" = plant biomass expressed in grams per unit of nitrogen in plant measured by SPAD.
"DW" = Plant Dry Weight;
"FW" = Plant Fresh weight;
"N level/DW" = plant Nitrogen level measured in SPAD unit per plant biomass [gr];
"DW/N level" = plant biomass per plant [gr]/SPAD unit;
Rosette Area (measured using digital analysis);
Plot Coverage at the indicated day [%] (calculated by the dividing the total plant area with the total plot area);
Leaf Blade Area at the indicated day [cm$^2$] (measured using digital analysis);
RGR (relative growth rate) of Rosette Area at the indicated day [cm$^2$/day] (calculated using Formula II);
t50 Flowering [day] (the day in which 50% of plant flower);
seed yield/rosette area at day 10 [gr/cm$^2$] (calculated);
seed yield/leaf blade [gr/cm$^2$] (calculated);
seed yield/N level [gr/cm$^2$ unit] (calculated).

Assessment of NUE, yield components and vigor-related parameters—Ten Arabidopsis ecotypes were grown in trays, each containing 8 plants per plot, in a greenhouse with controlled temperature conditions for about 12 weeks. Plants were irrigated with different nitrogen concentration as described above depending on the treatment applied. During this time, data was collected documented and analyzed. Most of chosen parameters were analyzed by digital imaging.

Digital Imaging—Greenhouse Assay

An image acquisition system, which consists of a digital reflex camera (Canon EOS 400D) attached with a 55 mm focal length lens (Canon EF-S series) placed in a custom made Aluminum mount, was used for capturing images of plants planted in containers within an environmental controlled greenhouse. The image capturing process is repeated every 2-3 days starting at day 9-12 till day 16-19 (respectively) from transplanting.

An image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data was saved to text files and analyzed using the JMP statistical analysis software (SAS institute).

Leaf analysis—Using the digital analysis leaves data was calculated, including leaf number, leaf blade area, plot coverage, Rosette diameter and Rosette area.

Relative growth rate area: The relative growth rate of the rosette and the leaves was calculated according to Formula II as described above.

Seed yield and 1000 seeds weight—At the end of the experiment all seeds from all plots were collected and weighed in order to measure seed yield per plant in terms of total seed weight per plant (gr). For the calculation of 1000 seed weight, an average weight of 0.02 grams was measured from each sample, the seeds were scattered on a glass tray and a picture was taken. Using the digital analysis, the number of seeds in each sample was calculated.

Dry weight and seed yield—At the end of the experiment, plant were harvested and left to dry at 30° C. in a drying chamber. The biomass was separated from the seeds, weighed and divided by the number of plants. Dry weight=total weight of the vegetative portion above ground (excluding roots) after drying at 30° C. in a drying chamber.

Harvest Index—The harvest index was calculated using Formula IV as described above [Harvest Index=Average seed yield per plant/Average dry weight].

$T_{50}$ days to flowering—Each of the repeats was monitored for flowering date. Days of flowering was calculated from sowing date till 50% of the plots flowered.

Plant nitrogen level—The chlorophyll content of leaves is a good indicator of the nitrogen plant status since the degree of leaf greenness is highly correlated to this parameter. Chlorophyll content was determined using a Minolta SPAD 502 chlorophyll meter and measurement was performed at time of flowering. SPAD meter readings were done on young fully developed leaf. Three measurements per leaf were taken per plot. Based on this measurement, parameters such as the ratio between seed yield per nitrogen unit [seed yield/N level=seed yield per plant [gr]/SPAD unit], plant DW per nitrogen unit [DW/N level=plant biomass per plant [g]/SPAD unit], and nitrogen level per gram of biomass [N level/DW=SPAD unit/plant biomass per plant (gr)] were calculated.

Percent of seed yield reduction—measures the amount of seeds obtained in plants when grown under nitrogen-limiting conditions compared to seed yield produced at normal nitrogen levels expressed in %.

Experimental Results 10 different *Arabidopsis* accessions (ecotypes) were grown and characterized for 37 parameters as described above. The average for each of the measured parameters was calculated using the JMP software and values are summarized in Table 9 below. Subsequent correlation analysis between the various transcriptom sets (Table 7) was conducted. Following are the results integrated to the database.

TABLE 9

Correlation between the expression level of selected genes in tissues under limiting or normal nitrogen fertilization and the phenotypic performance across *Arabidopsis* ecotypes

| Gene Name | Exp. Set | Corr. Vec. | R | Exp. Set | Corr. Vec. | R | Exp. Set | Corr. Vec. | R |
|---|---|---|---|---|---|---|---|---|---|
| BDL117 | D | 31 | −0.748 | A | 12 | −0.784 | | | |
| BDL118 | C | 11 | −0.914 | C | 10 | −0.723 | C | 14 | −0.75 |
| BDL118 | C | 8 | 0.74 | | | | | | |
| BDL118 | D | 31 | −0.766 | B | 30 | −0.752 | D | 30 | −0.794 |
| BDL118 | D | 29 | −0.715 | B | 27 | 0.791 | A | 11 | −0.747 |
| BDL126 | A | 1 | −0.719 | | | | | | |
| BDL126 | D | 25 | 0.801 | A | 6 | −0.715 | A | 2 | −0.711 |
| BDL138 | B | 28 | −0.797 | B | 27 | −0.786 | C | 9 | −0.754 |
| BDL140 | D | 28 | −0.761 | | | | | | |
| BDL147 | D | 30 | −0.703 | C | 11 | −0.7 | | | |
| BDL149 | C | 9 | −0.744 | A | 1 | 0.703 | | | |
| BDL152 | A | 14 | −0.705 | | | | | | |
| BDL154 | B | 26 | 0.896 | B | 32 | 0.76 | B | 33 | 0.861 |
| BDL155 | C | 9 | −0.719 | | | | | | |
| BDL155_H0 | B | 28 | 0.768 | D | 28 | 0.757 | D | 29 | 0.751 |
| BDL155_H0 | C | 7 | 0.743 | | | | | | |
| BDL156 | D | 24 | 0.725 | D | 21 | 0.734 | | | |
| BDL157 | B | 29 | 0.714 | | | | | | |
| BDL158 | B | 30 | −0.722 | B | 27 | 0.708 | | | |
| BDL160 | A | 12 | −0.807 | C | 9 | −0.771 | C | 5 | −0.797 |
| BDL160 | C | 2 | −0.816 | | | | | | |
| BDL162 | B | 31 | −0.792 | | | | | | |
| BDL165 | C | 11 | −0.755 | C | 8 | 0.748 | | | |
| BDL117 | D | 31 | −0.748 | A | 12 | −0.784 | | | |
| BDL118 | C | 11 | −0.914 | C | 10 | −0.723 | C | 14 | −0.75 |
| BDL118 | C | 8 | 0.74 | | | | | | |
| BDL167 | C | 10 | −0.898 | C | 14 | −0.894 | C | 13 | −0.874 |
| BDL167 | C | 15 | 0.737 | | | | | | |
| BDL167 | D | 30 | −0.75 | C | 11 | −0.709 | C | 7 | −0.821 |
| BDL168 | A | 9 | 0.703 | A | 11 | −0.786 | | | |
| BDL168 | B | 30 | −0.73 | D | 21 | 0.721 | B | 27 | 0.738 |
| BDL169 | A | 11 | −0.804 | A | 10 | −0.746 | A | 14 | −0.714 |
| BDL169 | A | 13 | −0.708 | A | 8 | 0.707 | | | |
| BDL171 | B | 33 | 0.865 | A | 9 | −0.735 | | | |
| BDL171 | D | 25 | 0.879 | B | 26 | 0.891 | D | 21 | 0.765 |
| BDL171 | D | 20 | 0.711 | B | 29 | 0.735 | B | 32 | 0.741 |
| BDL171_H0 | C | 15 | 0.719 | C | 8 | 0.78 | | | |
| BDL173 | B | 26 | 0.723 | B | 33 | 0.72 | A | 15 | 0.751 |
| BDL174 | C | 16 | 0.7 | C | 9 | −0.73 | | | |
| BDL176 | D | 25 | 0.713 | D | 24 | −0.713 | D | 26 | 0.765 |
| BDL176 | D | 21 | 0.702 | D | 20 | −0.719 | D | 32 | 0.806 |
| BDL176 | D | 33 | 0.759 | A | 7 | 0.746 | | | |
| BDL177 | B | 27 | −0.713 | A | 11 | 0.792 | | | |
| BDL181 | C | 10 | −0.75 | C | 14 | −0.795 | C | 13 | −0.805 |
| BDL181 | C | 15 | 0.72 | A | 8 | 0.794 | | | |
| BDL181 | D | 31 | −0.704 | B | 27 | 0.723 | C | 11 | −0.725 |
| BDL182 | A | 6 | 0.728 | A | 2 | 0.717 | A | 1 | 0.763 |
| BDL183 | A | 12 | −0.764 | | | | | | |
| BDL183_H0 | A | 2 | −0.725 | | | | | | |
| BDL186 | A | 10 | −0.754 | A | 13 | −0.713 | A | 15 | 0.805 |
| BDL186 | A | 8 | 0.865 | | | | | | |
| BDL186 | B | 31 | −0.714 | B | 27 | 0.722 | A | 11 | −0.816 |
| BDL187 | A | 2 | 0.711 | A | 1 | 0.801 | A | 10 | −0.775 |
| BDL187 | A | 14 | −0.843 | A | 13 | −0.89 | A | 15 | 0.721 |
| BDL189 | A | 13 | −0.859 | A | 15 | 0.748 | A | 8 | 0.759 |
| BDL189 | B | 30 | −0.702 | B | 27 | 0.832 | A | 11 | −0.71 |
| BDL189 | C | 7 | −0.714 | A | 10 | −0.825 | A | 14 | −0.82 |
| BDL192 | B | 24 | −0.788 | B | 21 | −0.863 | B | 20 | −0.857 |
| BDL192 | B | 29 | −0.701 | B | 32 | 0.769 | | | |
| BDL192 | D | 28 | −0.764 | B | 30 | −0.785 | B | 25 | −0.802 |

TABLE 9-continued

Correlation between the expression level of selected genes in tissues under limiting or normal nitrogen fertilization and the phenotypic performance across *Arabidopsis* ecotypes

| Gene Name | Exp. Set | Corr. Vec. | R | Exp. Set | Corr. Vec. | R | Exp. Set | Corr. Vec. | R |
|---|---|---|---|---|---|---|---|---|---|
| BDL193 | A | 6 | −0.754 | A | 2 | −0.781 | A | 1 | −0.875 |
| BDL193 | A | 14 | −0.732 | | | | | | |
| BDL193 | D | 30 | −0.721 | D | 29 | −0.819 | C | 11 | −0.7 |
| BDL117 | D | 31 | −0.748 | A | 12 | −0.784 | | | |
| BDL118 | C | 11 | −0.914 | C | 10 | −0.723 | C | 14 | −0.75 |
| BDL118 | C | 8 | 0.74 | | | | | | |
| BDL194 | B | 25 | 0.786 | B | 21 | 0.707 | | | |
| BDL196 | D | 25 | −0.715 | D | 21 | −0.71 | D | 20 | −0.715 |
| BDL197 | A | 6 | −0.701 | A | 5 | −0.843 | A | 2 | −0.89 |
| BDL197 | A | 1 | −0.827 | | | | | | |
| BDL201 | A | 10 | −0.768 | A | 14 | −0.84 | A | 13 | −0.872 |
| BDL201 | A | 15 | 0.746 | | | | | | |
| BDL201 | B | 29 | −0.815 | A | 2 | 0.747 | A | 1 | 0.784 |
| BDL220 | C | 11 | −0.81 | | | | | | |
| BDL220 | D | 30 | −0.707 | B | 29 | −0.785 | C | 9 | 0.752 |
| BDL221 | A | 2 | 0.768 | C | 2 | 0.763 | A | 1 | 0.817 |
| BDL221 | B | 31 | −0.81 | D | 25 | −0.743 | D | 24 | −0.896 |
| BDL221 | C | 1 | 0.74 | | | | | | |
| BDL221 | D | 21 | −0.826 | D | 20 | −0.776 | A | 5 | 0.825 |
| BDL222 | D | 27 | −0.716 | A | 11 | 0.77 | A | 14 | 0.731 |
| BDL223 | C | 11 | −0.757 | C | 15 | 0.786 | C | 8 | 0.821 |
| BDL223_H0 | C | 11 | −0.736 | | | | | | |
| BDL223_H1 | C | 8 | 0.784 | | | | | | |
| BDL223_H1 | D | 24 | 0.823 | A | 12 | 0.815 | C | 15 | 0.793 |
| BDL229 | C | 11 | −0.798 | C | 10 | −0.723 | C | 14 | −0.771 |
| BDL229 | C | 13 | −0.769 | A | 8 | 0.753 | C | 8 | 0.828 |
| BDL229 | D | 30 | −0.787 | B | 27 | 0.793 | D | 27 | 0.873 |
| BDL231 | A | 11 | −0.798 | C | 6 | −0.704 | A | 10 | −0.826 |
| BDL231 | A | 14 | −0.836 | A | 13 | −0.843 | A | 15 | 0.823 |
| BDL231 | A | 8 | 0.768 | | | | | | |
| BDL231_H0 | A | 11 | −0.779 | A | 10 | −0.799 | A | 14 | −0.841 |
| BDL231_H0 | A | 13 | −0.835 | A | 15 | 0.706 | A | 8 | 0.721 |
| BDL233 | C | 8 | 0.835 | | | | | | |
| BDL233 | D | 28 | 0.755 | C | 11 | −0.768 | C | 15 | 0.725 |
| BDL235 | C | 11 | −0.87 | C | 10 | −0.749 | A | 14 | −0.741 |
| BDL235 | C | 14 | −0.726 | A | 13 | −0.702 | C | 8 | 0.802 |
| BDL240 | A | 8 | 0.742 | | | | | | |
| BDL240 | D | 24 | 0.794 | B | 27 | 0.737 | A | 11 | −0.787 |
| BDL241 | B | 27 | 0.752 | | | | | | |
| BDL242 | A | 5 | −0.719 | A | 15 | −0.722 | | | |
| BDL245 | D | 31 | −0.875 | | | | | | |
| BDL117 | D | 31 | −0.748 | A | 12 | −0.784 | | | |
| BDL118 | C | 11 | −0.914 | C | 10 | −0.723 | C | 14 | −0.75 |
| BDL118 | C | 8 | 0.74 | | | | | | |
| BDL247 | D | 31 | 0.851 | | | | | | |
| BDL249 | A | 8 | −0.707 | | | | | | |
| BDL249 | C | 12 | 0.707 | A | 11 | 0.82 | A | 10 | 0.727 |
| BDL250 | A | 10 | 0.717 | A | 14 | 0.797 | A | 13 | 0.81 |
| BDL252 | C | 9 | −0.707 | C | 7 | −0.714 | | | |
| BDL49 | B | 30 | 0.866 | B | 26 | 0.85 | B | 29 | 0.933 |
| BDL49 | B | 33 | 0.762 | | | | | | |
| BDL58 | B | 26 | 0.763 | D | 26 | 0.755 | B | 29 | 0.897 |
| BDL58 | C | 14 | 0.816 | C | 13 | 0.855 | C | 15 | −0.784 |
| BDL58 | C | 8 | −0.843 | | | | | | |
| BDL58 | D | 32 | 0.758 | D | 33 | 0.778 | C | 10 | 0.8 |
| BDL62 | C | 11 | −0.858 | C | 10 | −0.739 | C | 14 | −0.77 |
| BDL62 | C | 13 | −0.747 | C | 8 | 0.819 | | | |
| BDL63 | C | 16 | −0.704 | | | | | | |
| BDL64 | B | 31 | −0.793 | C | 5 | −0.739 | | | |
| BDL70_H0 | C | 8 | 0.757 | | | | | | |
| BDL75 | C | 11 | −0.716 | C | 8 | 0.713 | | | |
| BDL75 | D | 31 | −0.776 | D | 28 | 0.75 | D | 30 | −0.832 |
| BDL79 | B | 31 | −0.77 | | | | | | |
| BDL85 | C | 10 | 0.824 | C | 14 | 0.754 | C | 13 | 0.721 |
| BDL85 | C | 15 | −0.705 | | | | | | |

Table 9. Provided are the correlations (R) between the expression levels of selected genes in tissues (leaves or stems) under limiting (1.5 mM Nitrogen) or normal (6 mM Nitrogen) conditions (Expression sets) and the phenotypic performance in various yield (seed yield, oil yield, oil content), biomass, growth rate and/or vigor components [Correlation (Corr.) vector (Vec.)] under limiting or normal Nitrogen conditions.
Corr. Vec. = correlation vector according to Table 8 hereinabove;
Exp. Set = expression set according to Table 7 hereinabove.

Example 4

Production of *Sorghum* Transcription and High Throughput Correlation Analysis with ABST Related Parametrers Using 44K *Sorguhm* Oligonucleotide Micro-Arrays In order to produce a high throughput correlation analysis, the present inventors utilized a *Sorghum* oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 44,000 *Sorghum* genes and transcripts. In order to define correlations between the levels of RNA expression with ABST and yield components or vigor related parameters, various plant characteristics of 17 different *sorghum* varieties were analyzed. Among them, 10 varieties encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Correlation of *Sorghum* Varieties Across Ecotype Grown Under Severe Drought Conditions Experimental Procedures 17 *Sorghum* varieties were grown in 3 repetitive plots, in field. Briefly, the growing protocol was as follows: *sorghum* seeds were sown in soil and grown under normal condition until around 35 days from sowing, around V8 (Last leaf visible, but still rolled up, ear beginning to swell). At this point, irrigation was stopped, and severe drought stress was developed. In order to define correlations between the levels of RNA expression with drought, yield components or vigor related parameters, the 17 different *sorghum* varieties were analyzed. Among them, 10 varieties encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

RNA extraction—All 10 selected *Sorghum* varieties were sample per each treatment. Plant tissues [Flag leaf and Flower meristem] growing under severe drought stress and plants grown under Normal conditions were sampled and RNA was extracted using TRIzol Reagent from Invitrogen [Hypertext Transfer Protocol://World Wide Web (dot) invitrogen (dot) com/content (dot)cfm?pageid=469]. For convenience, each micro-array expression information tissue type has received a Set ID as summarized in Table 10 below.

TABLE 10

*Sorghum* transcriptom expression sets

| Expression Set | Set ID |
|---|---|
| Drought Stress: Flag leaf | U |
| Normal conditions: Flag leaf | X |
| Normal conditions: Flower meristem | Y |

Table 10: Provided are the *sorghum* transcriptom expression set U, X and Y. Flag leaf = the leaf below the flower;
Flower meristem = Apical meristem following panicle initiation.

The collected data parameters were as follows:

Grain per Plant (gr.)—At the end of the experiment (Inflorescence were dry) all spikes from plots within blocks A-C were collected. 5 Inflorescence were separately threshed and grains were weighted, all additional Inflorescence were threshed together and weighted as well. The average weight per Inflorescence was calculated by dividing the total grain weight by number of total Inflorescence per plot, or in case of 5 inflorescence, by weight by the total grain number by 5.

Plant height—Plants were characterized for height during growing period at 6 time points. In each measure, plants were measured for their height using a measuring tape. Height was measured from ground level to top of the longest leaf.

Inflorescence Weight (gr.)—At the end of the experiment (when Inflorescence were dry) five Inflorescence from plots within blocks A-C were collected. The Inflorescence were weighted (gr.).

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Vegetative dry weight and Inflorescence—At the end of the experiment (when Inflorescence were dry) all Inflorescence and vegetative material from plots within blocks A-C were collected. The biomass and Inflorescence weight of each plot was separated, measured and divided by the number of Inflorescence.

Dry weight=total weight of the vegetative portion above ground (excluding roots) after drying at 70° C. in oven for 48 hours;

Harvest Index (for *sorghum*)—The harvest index is calculated using Formula VIII.

$$\text{Harvest Index} = \text{Average grain dry weight per Inflorescence}/(\text{Average vegetative dry weight per Inflorescence} + \text{Average Inflorescence dry weight}) \quad \text{Formula VIII:}$$

Experimental Results 16 different *sorghum* varieties were grown and characterized for 7 parameters: "Seed/plant normal"=total seed weight per plant under normal conditions; "DW-5 Inflorescence Normal"—dry weight of five complete inflorescences (seeds and rachis) under normal conditions; "DW all Normal"=dry weight of per plot under normal conditions; "Weight of seeds (5 heads) gr Normal"=dry weight of seeds from five inflorescences under normal conditions; "Plant Height 4 Drought"=plant height in the $4^{th}$ 4 time point under drought conditions; "Plant Height 4 Normal"=plant height in the $4^{th}$ time point under normal conditions; "Plant Height 6 Normal"=plant height in the $6^{th}$ time point under normal conditions. The average for each of the measured parameter was calculated using the JMP software and values are summarized in Table 11 below. Subsequent correlation analysis between the various transcriptom sets (Table 10) and the average parameters, was conducted (Tables 12). Results were then integrated to the database.

TABLE 11

Measured parameters in Sorghum accessions

| Seed ID | Seed/Plant Normal | DW-5 Inflorescence Normal | DW all Normal | Weight of seeds (5 heads) gr Normal | Plant Height 4 Drought | Plant Height 4 Normal | Plant Height 6 Normal |
|---|---|---|---|---|---|---|---|
| 20 | 0.031 | 0.039 | 5.408 | 0.237 | 38.000 | 37.313 | 37.313 |
| 21 | 0.026 | 0.062 | 3.091 | 0.225 | 30.833 | | |
| 22 | 0.019 | 0.033 | 21.341 | 0.142 | 110.833 | 47.750 | 47.750 |
| 24 | 0.038 | 0.030 | 5.329 | 0.352 | 42.833 | 40.083 | 40.083 |
| 25 | 0.027 | 0.074 | 20.600 | 0.161 | 49.583 | 45.938 | 45.938 |
| 26 | 0.046 | 0.049 | 21.685 | 0.332 | 49.750 | 41.438 | 41.438 |
| 27 | 0.048 | 0.046 | 11.205 | 0.317 | 46.875 | 44.875 | 44.875 |
| 28 | 0.031 | 0.033 | 9.045 | 0.222 | 41.917 | 42.125 | 42.125 |
| 29 | 0.040 | 0.048 | 10.293 | 0.283 | 46.125 | 41.000 | 41.000 |
| 30 | 0.038 | 0.038 | 9.139 | 0.300 | 50.167 | 42.500 | 42.063 |
| 31 | 0.032 | 0.023 | 9.549 | 0.227 | 43.583 | 41.875 | 41.875 |
| 32 | 0.033 | 0.039 | 10.424 | 0.277 | 50.833 | 43.375 | 43.375 |
| 33 | 0.033 | 0.049 | 10.150 | 0.353 | 42.417 | 39.813 | 39.813 |
| 34 | 0.052 | 0.050 | 8.783 | 0.351 | 45.500 | 40.625 | 40.625 |
| 35 | 0.036 | 0.038 | 10.259 | 0.270 | 50.375 | 44.375 | 44.375 |
| 36 | 0.038 | 0.042 | 12.005 | 0.299 | 48.833 | 43.250 | 43.250 |
| 37 | 0.042 | 0.063 | 15.681 | 0.263 | 49.833 | 41.000 | 41.000 |

Table 11: Provided are the values of each of the parameters (as described above) measured in Sorghum accessions (Seed ID) under normal and drought conditions. Growth conditions are specified in the experimental procedure section.

TABLE 12

Correlation between the expression level of homologues of selected genes in various tissues and the phenotypic performance under normal or abiotic stress conditions across Sorghum accessions

| Gene Name | Exp. Set | Corr. Vec. | R |
|---|---|---|---|
| BDL102_H47 | flower | DW all Normal | −0.721 |
| BDL102_H47 | flower | FW-Inflorescence/ Plant Normal | 0.717 |
| BDL102_H47 | flower | Plant Height 4 Normal | −0.722 |
| BDL102_H47 | flower | Plant Height 6 Normal | −0.718 |
| BDL83_H57 | flag leaf | DW-5 Inflorescence Normal | −0.712 |
| BDL83_H57 | flag leaf | Seed/Plant Normal | −0.708 |
| BDL83_H57 | flower | Plant Height 4 Normal | 0.858 |
| BDL83_H57 | flower | Plant Height 6 Normal | 0.853 |
| BDL83_H58 | flag leaf | Plant Height 4 Drought | 0.763 |
| BDL83_H58 | flower | Seed/Plant Low-N | 0.759 |
| BDL83_H58 | flower | Weight of seeds (5 heads) gr Normal | −0.707 |
| BDL83_H58 | Flower meristem | Leaf_No 2 Normal | 0.802 |
| BDL88_H13 | Flag leaf | Leaf_No 3 Drought | −0.893 |
| BDL88_H13 | Flag leaf | Leaf_TP 1 Drought | −0.929 |
| BDL88_H13 | Flag leaf | Plant Height 2 Drought | −0.796 |
| BDL88_H13 | Flag leaf | Plant Height 3 Drought | −0.837 |
| BDL88_H13 | Flag leaf | Seed/Plant_Normal | 0.73 |

Table 12. Provided are the correlations (R) between the expression levels of homologues of selected genes in tissues (Flag leaf or Flower meristem; Expression sets) and the phenotypic performance in various yield, biomass, growth rate and/or vigor components [Correlation (Corr.) vector (Vec.)] under abiotic stress conditions (drought) or normal conditions across Sorghum accessions.

Sorghum vigor related parameters under 100 mM NaCl and low temperature (8-10° C.)—Ten Sorghum varieties were grown in 3 repetitive plots, each containing 17 plants, at a net house under semi-hydroponics conditions. Briefly, the growing protocol was as follows: Sorghum seeds were sown in trays filled with a mix of vermiculite and peat in a 1:1 ratio. Following germination, the trays were transferred to the high salinity solution (100 mM NaCl in addition to the Full Hogland solution), low temperature (8-10° C. in the presence of Full Hogland solution) or at Normal growth solution [Full Hogland solution at 20-24° C].

Full Hogland solution consists of: $KNO_3$—0.808 grams/liter, $MgSO_4$—0.12 grams/liter, $KH2 PO_4$—0.172 grams/liter and 0.01% (volume/volume) of 'Super coratin' micro elements (Iron-EDDHA [ethylenediamine-N,N'-bis(2-hydroxyphenylacetic acid)]—40.5 grams/liter; Mn—20.2 grams/liter; Zn 10.1 grams/liter; Co 1.5 grams/liter; and Mo 1.1 grams/liter), solution's pH should be 6.5-6.8].

RNA extraction—All 10 selected Sorghum varieties were sampled per each treatment. Two tissues [leaves and roots] growing at 100 mM NaCl, low temperature (8-10° C.) or under Normal conditions (full Hogland at a temperature between 20-24° C.) were sampled and RNA was extracted using TRIzol Reagent from Invitrogen [Hypertext Transfer Protocol://World Wide Web (dot) invitrogen (dot) com/content (dot)cfm?pageid=469].

Experimental Results 10 different Sorghum varieties were grown and characterized for the following parameters: "Leaf number Normal"=leaf number per plant under normal conditions (average of five plants); "Plant Height Normal"=plant height under normal conditions (average of five plants); "Root DW 100 mM NaCl"—root dry weight per plant under salinity conditions (average of five plants); The average for each of the measured parameter was calculated using the IMP software and values are summarized in Table 13 below. Subsequent correlation analysis between the various transcriptom sets and the average parameters was conducted (Table 14). Results were then integrated to the database.

TABLE 13

Measured parameters in Sorghum accessions

| Seed ID | Plant Height T1 NaCl | Plant Height T1 + 8 NaCl | Plant Height T1 + 15 NaCl | Leaf number T1 NaCl | Leaf number T1 + 8 Normal | DW Root/Plant NaCl |
|---|---|---|---|---|---|---|
| 20 | 7.900 | 14.200 | 21.800 | 3.000 | 4.167 | 0.05 |
| 22 | 9.500 | 16.267 | 23.167 | 3.133 | 4.500 | 0.10447479 |

TABLE 13-continued

Measured parameters in *Sorghum* accessions

| Seed ID | Plant Height T1 NaCl | Plant Height T1 + 8 NaCl | Plant Height T1 + 15 NaCl | Leaf number T1 NaCl | Leaf number T1 + 8 Normal | DW Root/Plant NaCl |
|---|---|---|---|---|---|---|
| 26 | 10.933 | 20.367 | 30.367 | 3.400 | 4.800 | 0.12370635 |
| 27 | 7.933 | 13.333 | 22.833 | 3.067 | 4.600 | 0.06880519 |
| 28 | 9.700 | 15.900 | 23.700 | 3.333 | 4.533 | 0.07568254 |
| 29 | 8.533 | 16.533 | 23.300 | 3.067 | 4.967 | 0.07517045 |
| 30 | 8.900 | 15.467 | 22.467 | 3.067 | 4.600 | 0.13539542 |
| 31 | 10.367 | 18.933 | 26.833 | 3.267 | 4.933 | 0.09546434 |
| 34 | 7.000 | 13.680 | 20.280 | 3.000 | 4.500 | 0.16491667 |
| 37 | 7.833 | 15.767 | 23.567 | 3.067 | 4.567 | 0.13888278 |

Table 13: Provided are the measured parameters of the *Sorghum* Accessions under normal conditions or high salt conditions at the indicated time points.
T1 (first day of measurements);
T1 + 8 (8 days following the first day);
T1 + 15 (15 days following the first day).
The exact conditions are detailed above in the experiment description section.

TABLE 14

Correlation between the expression level of homologues of selected genes in roots and the phenotypic performance under normal or abiotic stress conditions across *Sorghum* accessions

| Gene Name | Exp. Set | Corr. Vec. | R |
|---|---|---|---|
| BDL83_H58 | root | DW Root/Plant NaCl | 0.897 |
| BDL83_H58 | root | Leaf number T1 NaCl | −0.75 |
| BDL83_H58 | root | Plant Height T1 NaCl | −0.82 |
| BDL83_H58 | root | Plant Height T1 + 8 NaCl | −0.9 |
| BDL83_H58 | root | Plant Height T1 + 15 NaCl | −0.77 |
| BDL83_H58 | root | Leaf number T1 Normal | 0.779 |

Table 14. Provided are the correlations (R) between the expression levels of homologues of selected genes in roots [Expression (Exp.) sets] and the phenotypic performance [yield, biomass, growth rate and/or vigor components (Correlation vector)] at the indicated time points under abiotic stress conditions (salinity) or normal conditions across *Sorghum* accessions.
Corr. Vec. = correlation vector as described hereinabove (Table 13).
T1 (first day of measurements);
T1 + 8 (8 days following the first day);
T1 + 15 (15 days following the first day).

Example 5

Identification of Genes which Increase Yield, Biomass, Growth Rate, Vigor, Oil Content, Abiotic Stress Tolerance of Plants and Nitrogen Use Efficieny Based on the above described bioinformatics and experimental tools, the present inventors have identified 105 genes (89 distinct gene families) which have a major impact on yield, seed yield, oil yield, biomass, growth rate, vigor, oil content, abiotic stress tolerance, and/or nitrogen use efficiency when expression thereof is increased in plants. The identified genes, their curated polynucleotide and polypeptide sequences, as well as their updated sequences according to Genbank database are summarized in Table 15, hereinbelow.

TABLE 15

Identified polynucleotides which affect plant yield, seed yield, oil yield, oil content, biomass, growth rate, vigor, abiotic stress tolerance and/or nitrogen use efficiency of a plant

| Serial No | Gene Name | Cluster Name | Organism | Polynucleotide SEQ ID NO: | Polypeptide SEQ ID NO: |
|---|---|---|---|---|---|
| 1 | BDL47 | arabidopsis\|gb165\|AT4G38660 | *arabidopsis* | 1 | 106 |
| 2 | BDL47 | arabidopsis\|gb165\|AT4G38660 | *arabidopsis* | 1 | 194 |
| 3 | BDL48 | arabidopsis\|gb165\|AT2G25270 | *arabidopsis* | 2 | 107 |
| 4 | BDL62 | arabidopsis\|gb165\|AT1G64390 | *arabidopsis* | 3 | 108 |
| 5 | BDL75 | arabidopsis\|gb165\|AT3G55420 | *arabidopsis* | 4 | 109 |
| 6 | BDL79 | arabidopsis\|gb165\|AT3G20010 | *arabidopsis* | 5 | 110 |
| 7 | BDL81 | arabidopsis\|gb165\|AT1G13030 | *arabidopsis* | 6 | 111 |
| 8 | BDL83 | arabidopsis\|gb165\|AT1G43670 | *arabidopsis* | 7 | 112 |
| 9 | BDL117 | arabidopsis\|gb165\|AT4G33240 | *arabidopsis* | 8 | 113 |
| 10 | BDL118 | arabidopsis\|gb165\|AT2G22125 | *arabidopsis* | 9 | 114 |
| 11 | BDL126 | arabidopsis\|gb165\|AT3G59100 | *arabidopsis* | 10 | 115 |
| 12 | BDL138 | arabidopsis\|gb165\|AT3G12180 | *arabidopsis* | 11 | 116 |
| 13 | BDL140 | arabidopsis\|gb165\|AT5G02640 | *arabidopsis* | 12 | 117 |
| 14 | BDL147 | arabidopsis\|gb165\|AT2G47930 | *arabidopsis* | 13 | 118 |
| 15 | BDL149 | arabidopsis\|gb165\|AT5G15750 | *arabidopsis* | 14 | 119 |
| 16 | BDL152 | arabidopsis\|gb165\|AT1G70420 | *arabidopsis* | 15 | 120 |
| 17 | BDL153 | arabidopsis\|gb165\|AT5G47690 | *arabidopsis* | 16 | 121 |
| 18 | BDL154 | arabidopsis\|gb165\|AT1G62940 | *arabidopsis* | 17 | 122 |
| 19 | BDL155 | arabidopsis\|gb165\|AT4G11630 | *arabidopsis* | 18 | 123 |
| 20 | BDL156 | arabidopsis\|gb165\|AT1G01570 | *arabidopsis* | 19 | 124 |
| 21 | BDL157 | arabidopsis\|gb165\|AT1G14560 | *arabidopsis* | 20 | 125 |
| 22 | BDL158 | arabidopsis\|gb165\|AT1G22030 | *arabidopsis* | 21 | 126 |
| 23 | BDL160 | arabidopsis\|gb165\|AT1G28960 | *arabidopsis* | 22 | 127 |

TABLE 15-continued

Identified polynucleotides which affect plant yield, seed yield, oil yield, oil content, biomass, growth rate, vigor, abiotic stress tolerance and/or nitrogen use efficiency of a plant

| Serial No | Gene Name | Cluster Name | Organism | Polynucleotide SEQ ID NO: | Polypeptide SEQ ID NO: |
|---|---|---|---|---|---|
| 24 | BDL162 | arabidopsis\|gb165\|AT1G49360 | arabidopsis | 23 | 128 |
| 25 | BDL163 | arabidopsis\|gb165\|AT1G51430 | arabidopsis | 24 | 129 |
| 26 | BDL165 | arabidopsis\|gb165\|AT1G65010 | arabidopsis | 25 | 130 |
| 27 | BDL167 | arabidopsis\|gb165\|AT1G79630 | arabidopsis | 26 | 131 |
| 28 | BDL168 | arabidopsis\|gb165\|AT2G01910 | arabidopsis | 27 | 132 |
| 29 | BDL169 | arabidopsis\|gb165\|AT2G19120 | arabidopsis | 28 | 133 |
| 30 | BDL171 | arabidopsis\|gb165\|AT2G32320 | arabidopsis | 29 | 134 |
| 31 | BDL173 | arabidopsis\|gb165\|AT2G36720 | arabidopsis | 30 | 135 |
| 32 | BDL174 | arabidopsis\|gb165\|AT2G39580 | arabidopsis | 31 | 136 |
| 33 | BDL176 | arabidopsis\|gb165\|AT3G10160 | arabidopsis | 32 | 137 |
| 34 | BDL177 | arabidopsis\|gb165\|AT3G18610 | arabidopsis | 33 | 138 |
| 35 | BDL181 | arabidopsis\|gb165\|AT4G12640 | arabidopsis | 34 | 139 |
| 36 | BDL182 | arabidopsis\|gb165\|AT4G14605 | arabidopsis | 35 | 140 |
| 37 | BDL183 | arabidopsis\|gb165\|AT4G15620 | arabidopsis | 36 | 141 |
| 38 | BDL186 | arabidopsis\|gb165\|AT4G32560 | arabidopsis | 37 | 142 |
| 39 | BDL187 | arabidopsis\|gb165\|AT4G35130 | arabidopsis | 38 | 143 |
| 40 | BDL188 | arabidopsis\|gb165\|AT4G35560 | arabidopsis | 39 | 144 |
| 41 | BDL189 | arabidopsis\|gb165\|AT5G05560 | arabidopsis | 40 | 145 |
| 42 | BDL190 | arabidopsis\|gb165\|AT5G06690 | arabidopsis | 41 | 146 |
| 43 | BDL192 | arabidopsis\|gb165\|AT5G09880 | arabidopsis | 42 | 147 |
| 44 | BDL193 | arabidopsis\|gb165\|AT5G12950 | arabidopsis | 43 | 148 |
| 45 | BDL194 | arabidopsis\|gb165\|AT5G16540 | arabidopsis | 44 | 149 |
| 46 | BDL196 | arabidopsis\|gb165\|AT5G38180 | arabidopsis | 45 | 150 |
| 47 | BDL197 | arabidopsis\|gb165\|AT5G39240 | arabidopsis | 46 | 151 |
| 48 | BDL200 | arabidopsis\|gb165\|AT5G51470 | arabidopsis | 47 | 152 |
| 49 | BDL201 | arabidopsis\|gb165\|AT5G58250 | arabidopsis | 48 | 153 |
| 50 | BDL203 | arabidopsis\|gb165\|AT5G66440 | arabidopsis | 49 | 154 |
| 51 | BDL219 | arabidopsis\|gb165\|AT1G36095 | arabidopsis | 50 | 155 |
| 52 | BDL220 | arabidopsis\|gb165\|AT1G61170 | arabidopsis | 51 | 156 |
| 53 | BDL221 | arabidopsis\|gb165\|AT1G75860 | arabidopsis | 52 | 157 |
| 54 | BDL222 | arabidopsis\|gb165\|AT1G77885 | arabidopsis | 53 | 158 |
| 55 | BDL223 | arabidopsis\|gb165\|AT2G37975 | arabidopsis | 54 | 159 |
| 56 | BDL229 | arabidopsis\|gb165\|AT5G53830 | arabidopsis | 55 | 160 |
| 57 | BDL230 | arabidopsis\|gb154\|ATHPEARA | arabidopsis | 56 | 161 |
| 58 | BDL231 | arabidopsis\|gb165\|AT1G16350 | arabidopsis | 57 | 162 |
| 59 | BDL235 | arabidopsis\|gb165\|AT2G38970 | arabidopsis | 58 | 163 |
| 60 | BDL242 | arabidopsis\|gb165\|AT3G22740 | arabidopsis | 59 | 164 |
| 61 | BDL243 | arabidopsis\|gb165\|AT3G31430 | arabidopsis | 60 | 165 |
| 62 | BDL245 | arabidopsis\|gb165\|AT4G12690 | arabidopsis | 61 | 166 |
| 63 | BDL247 | arabidopsis\|gb165\|AT4G29510 | arabidopsis | 62 | 167 |
| 64 | BDL248 | arabidopsis\|gb165\|AT4G37360 | arabidopsis | 63 | 168 |
| 65 | BDL250 | arabidopsis\|gb165\|AT4G37400 | arabidopsis | 64 | 169 |
| 66 | BDL49 | arabidopsis\|gb165\|AT3G06180 | arabidopsis | 65 | 170 |
| 67 | BDL58 | arabidopsis\|gb165\|AT1G22160 | arabidopsis | 66 | 171 |
| 68 | BDL63 | arabidopsis\|gb165\|AT2G40550 | arabidopsis | 67 | 172 |
| 69 | BDL64 | arabidopsis\|gb165\|AT5G38020 | arabidopsis | 68 | 173 |
| 70 | BDL70 | cotton\|gb164\|AF150730 | cotton | 69 | 174 |
| 71 | BDL85 | arabidopsis\|gb165\|AT1G05340 | arabidopsis | 70 | 175 |
| 72 | BDL88 | rice\|gb157.2\|AA754446 | rice | 71 | 176 |
| 73 | BDL90 | rice\|gb154\|AK102950 | rice | 72 | |
| 74 | BDL94 | rice\|gb157.2\|BE228242 | rice | 73 | 177 |
| 75 | BDL102 | maize\|gb164\|AI600933 | maize | 74 | 178 |
| 76 | BDL224 | arabidopsis\|gb165\|AT4G29780 | arabidopsis | 75 | 179 |
| 77 | BDL225 | arabidopsis\|gb165\|AT5G39670 | arabidopsis | 76 | 180 |
| 78 | BDL226 | arabidopsis\|gb165\|AT5G65470 | arabidopsis | 77 | 181 |
| 79 | BDL227 | arabidopsis\|gb165\|AT3G56410 | arabidopsis | 78 | 182 |
| 80 | BDL228 | castorbean\|gb160\|EE256201 | castorbean | 79 | 183 |
| 81 | BDL232 | arabidopsis\|gb165\|AT1G56100 | arabidopsis | 80 | 184 |
| 82 | BDL233 | arabidopsis\|gb165\|AT1G66360 | arabidopsis | 81 | 185 |
| 83 | BDL234 | arabidopsis\|gb165\|AT2G05400 | arabidopsis | 82 | 186 |
| 84 | BDL237 | arabidopsis\|gb165\|AT2G45510 | arabidopsis | 83 | 187 |
| 85 | BDL238 | arabidopsis\|gb165\|AT3G04540 | arabidopsis | 84 | 188 |
| 86 | BDL240 | arabidopsis\|gb165\|AT3G18480 | arabidopsis | 85 | 189 |
| 87 | BDL241 | arabidopsis\|gb165\|AT3G20020 | arabidopsis | 86 | 190 |
| 88 | BDL249 | arabidopsis\|gb165\|AT4G37370 | arabidopsis | 87 | 191 |
| 89 | BDL251 | arabidopsis\|gb165\|AT5G08250 | arabidopsis | 88 | 192 |
| 90 | BDL252 | arabidopsis\|gb165\|AT5G18650 | arabidopsis | 89 | 193 |
| 91 | BDL79 | arabidopsis\|gb165\|AT3G20010 | arabidopsis | 90 | 110 |
| 92 | BDL126 | arabidopsis\|gb165\|AT3G59100 | arabidopsis | 91 | 115 |
| 93 | BDL153 | arabidopsis\|gb165\|AT5G47690 | arabidopsis | 92 | 195 |
| 94 | BDL156 | arabidopsis\|gb165\|AT1G01570 | arabidopsis | 93 | 124 |
| 95 | BDL167 | arabidopsis\|gb165\|AT1G79630 | arabidopsis | 94 | 196 |
| 96 | BDL169 | arabidopsis\|gb165\|AT2G19120 | arabidopsis | 95 | 197 |

TABLE 15-continued

Identified polynucleotides which affect plant yield, seed yield, oil yield, oil content, biomass, growth rate, vigor, abiotic stress tolerance and/or nitrogen use efficiency of a plant

| Serial No | Gene Name | Cluster Name | Organism | Polynucleotide SEQ ID NO: | Polypeptide SEQ ID NO: |
|---|---|---|---|---|---|
| 97 | BDL171 | arabidopsis\|gb165\|AT2G32320 | arabidopsis | 96 | 134 |
| 98 | BDL174 | arabidopsis\|gb165\|AT2G39580 | arabidopsis | 97 | 198 |
| 99 | BDL187 | arabidopsis\|gb165\|AT4G35130 | arabidopsis | 98 | 143 |
| 100 | BDL189 | arabidopsis\|gb165\|AT5G05560 | arabidopsis | 99 | 199 |
| 101 | BDL197 | arabidopsis\|gb165\|AT5G39240 | arabidopsis | 100 | 200 |
| 102 | BDL200 | arabidopsis\|gb165\|AT5G51470 | arabidopsis | 101 | 152 |
| 103 | BDL231 | arabidopsis\|gb165\|AT1G16350 | arabidopsis | 102 | 162 |
| 104 | BDL248 | arabidopsis\|gb165\|AT4G37360 | arabidopsis | 103 | 168 |
| 105 | BDL70 | cotton\|gb164\|AF150730 | cotton | 104 | 201 |
| 106 | BDL238 | arabidopsis\|gb165\|AT3G04540 | arabidopsis | 105 | 202 |

Table 15: Provided are the identified genes, their annotation, organism and polynucleotide and polypeptide sequence identifiers.

Example 6

Identification of Homologous Sequences that Increase Seed Yield, Oil Yield, Growth Rate, Oil Content, Biomass, Vigor, ABST Resistance and/or Nue of a Plant The concepts of orthology and paralogy have recently been applied to functional characterizations and classifications on the scale of whole-genome comparisons. Orthologs and paralogs constitute two major types of homologs: The first evolved from a common ancestor by specialization, and the latter are related by duplication events. It is assumed that paralogs arising from ancient duplication events are likely to have diverged in function while true orthologs are more likely to retain identical function over evolutionary time.

To identify putative orthologs of the genes affecting plant yield, oil yield, oil content, seed yield, growth rate, vigor, biomass, abiotic stress tolerance and/or nitrogen use efficiency, all sequences were aligned using the BLAST (Basic Local Alignment Search Tool). Sequences sufficiently similar were tentatively grouped. These putative orthologs were further organized under a Phylogram—a branching diagram (tree) assumed to be a representation of the evolutionary relationships among the biological taxa. Putative ortholog groups were analyzed as to their agreement with the phylogram and in cases of disagreements these ortholog groups were broken accordingly.

Expression data was analyzed and the EST libraries were classified using a fixed vocabulary of custom terms such as developmental stages (e.g., genes showing similar expression profile through development with up regulation at specific stage, such as at the seed filling stage) and/or plant organ (e.g., genes showing similar expression profile across their organs with up regulation at specific organs such as seed). The annotations from all the ESTs clustered to a gene were analyzed statistically by comparing their frequency in the cluster versus their abundance in the database, allowing the construction of a numeric and graphic expression profile of that gene, which is termed "digital expression". The rationale of using these two complementary methods with methods of phenotypic association studies of QTLs, SNPs and phenotype expression correlation is based on the assumption that true orthologs are likely to retain identical function over evolutionary time. These methods provide different sets of indications on function similarities between two homologous genes, similarities in the sequence level—identical amino acids in the protein domains and similarity in expression profiles.

Methods for searching and identifying homologues of yield and improved agronomic traits such as ABS tolerance and NUE related polypeptides or polynucleotides are well within the realm of the skilled artisan. The search and identification of homologous genes involves the screening of sequence information available, for example, in public databases such as the DNA Database of Japan (DDBJ), Genbank, and the European Molecular Biology Laboratory Nucleic Acid Sequence Database (EMBL) or versions thereof or the MIPS database. A number of different search algorithms have been developed, including but not limited to the suite of programs referred to as BLAST programs. There are five implementations of BLAST, three designed for nucleotide sequence queries (BLASTN, BLASTX, and TBLASTX) and two designed for protein sequence queries (BLASTP and TBLASTN) (Coulson, Trends in Biotechnology: 76-80, 1994; Birren et al., Genome Analysis, I: 543, 1997). Such methods involve alignment and comparison of sequences. The BLAST algorithm calculates percent sequence identity and performs a statistical analysis of the similarity between the two sequences. The software for performing BLAST analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48: 443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis one may use standard programs for multiple alignments e.g. Clustal W. A neighbour-joining tree of the proteins homologous to the genes in this invention may be used to provide an overview of structural and ancestral relationships. Sequence identity may be calculated using an alignment program as described above. It is expected that other plants will carry a similar functional gene (ortholog) or a family of similar genes and those genes will provide the same preferred phenotype as the genes presented here. Advantageously, these family members may be useful in the methods of the invention. Example of other plants are included here but not limited to, barley (*Hordeum vulgare*), Arabidopsis (*Arabidopsis thaliana*), maize (*Zea mays*), cotton (*Gossypium*), Oilseed rape (*Brassica napus*), Rice (*Oryza sativa*), Sugar cane (*Saccharum* officinarum), Sorghum (*Sorghum bicolor*), Soybean (*Glycine max*), Sunflower (*Helianthus annuus*), Tomato (*Lycopersicon esculentum*), Wheat (*Triticum aestivum*).

The above-mentioned analyses for sequence homology can be carried out on a full-length sequence, but may also be based on a comparison of certain regions such as conserved domains. The identification of such domains, would also be well within the realm of the person skilled in the art and would involve, for example, a computer readable format of the nucleic acids of the present invention, the use of alignment software programs and the use of publicly available information on protein domains, conserved motifs and boxes. This information is available in the PRODOM (Hypertext Transfer Protocol://World Wide Web (dot) biochem (dot) ucl (dot) ac (dot) uk/bsm/dbbrowser/protocol/prodomqry (dot) html), PIR (Hypertext Transfer Protocol://pir (dot) Georgetown (dot) edu/) or Pfam (Hypertext Transfer Protocol://World Wide Web (dot) sanger (dot) ac (dot) uk/Software/Pfam/) database. Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass, peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break a-helical structures or 3-sheet structures). Conservative substitution tables are well known in the art (see for example Creighton (1984) Proteins. W.H. Freeman and Company). Homologues of a nucleic acid encompass nucleic acids having nucleotide substitutions, deletions and/or insertions relative to the unmodified nucleic acid in question and having similar biological and functional activity as the unmodified nucleic acid from which they are derived.

Polynucleotides and polypeptides with significant homology to the identified genes described in Table 15 above have been identified from the databases using BLAST software using the Blastp and tBlastn algorithms. The query nucleotide sequences were SEQ ID NOs: 1-106 and the identified homologues are provided in Table 16, below. These genes are expected to increase plant yield, seed yield, oil yield, oil content, growth rate, biomass, vigor, ABST and/or NUE of a plant.

TABLE 16

Homologous polynucleotides and polypeptides

| Polynuc. SEQ ID NO: | Gene Name | Organism/Cluster name | Polypep. SEQ ID NO: | Homol. to SEQ ID NO: | % Global identity | Algor. |
| --- | --- | --- | --- | --- | --- | --- |
| 203 | BDL47_H0 | radish\|gb164\|EW717854 | 524 | 194 | 85.15 | tblastn |
| 204 | BDL48_H0 | radish\|gb164\|EW735131 | 525 | 107 | 82.7 | blastp |
| 205 | BDL62_H0 | canola\|gb161\|CD835773 | 526 | 108 | 94.5 | blastp |
| 206 | BDL62_H1 | radish\|gb164\|EV543949 | 527 | 108 | 94.36 | tblastn |
| 207 | BDL75_H0 | canola\|gb161\|EE485008 | 528 | 109 | 84.1 | blastp |
| 208 | BDL83_H0 | apple\|gb171\|CN494551 | 529 | 112 | 86.8 | blastp |
| 209 | BDL83_H1 | aquilegia\|gb157.3\|DR916286 | 530 | 112 | 85.9 | blastp |
| 210 | BDL83_H2 | artemisia\|gb164\|EY037407 | 531 | 112 | 86.2 | blastp |
| 211 | BDL83_H3 | b_juncea\|gb164\|EVGN00808312601672 | 532 | 112 | 91.7 | blastp |
| 212 | BDL83_H4 | b_oleracea\|gb161\|AM387331 | 533 | 112 | 94.7 | blastp |
| 213 | BDL83_H5 | b_rapa\|gb162\|AY161288 | 534 | 112 | 94.4 | blastp |
| 214 | BDL83_H6 | banana\|gb167\|AF130251 | 535 | 112 | 85 | blastp |
| 215 | BDL83_H7 | barley\|gb157.3\|BE420760 | 536 | 112 | 83.4 | blastp |
| 216 | BDL83_H8 | barley\|gb157.3\|BG365169 | 537 | 112 | 82.1 | blastp |
| 217 | BDL83_H9 | bean\|gb167\|CA896765 | 538 | 112 | 87.1 | blastp |
| 218 | BDL83_H10 | bean\|gb167\|CB539815 | 539 | 112 | 87.4 | blastp |
| 219 | BDL83_H11 | beet\|gb162\|BE590341 | 540 | 112 | 85.9 | blastp |
| 220 | BDL83_H12 | brachypodium\|gb169\|BE213261 | 541 | 112 | 85.4 | blastp |
| 221 | BDL83_H13 | brachypodium\|gb169\|BE419504 | 542 | 112 | 82.7 | blastp |
| 222 | BDL83_H14 | canola\|gb161\|BNU20179 | 543 | 112 | 94.13 | tblastn |
| 223 | BDL83_H15 | canola\|gb161\|CD818253 | 544 | 112 | 94.4 | blastp |
| 224 | BDL83_H16 | cassava\|gb164\|DV445162 | 545 | 112 | 88 | blastp |
| 225 | BDL83_H17 | castorbean\|gb160\|EE256791 | 546 | 112 | 87.4 | blastp |
| 226 | BDL83_H18 | centaurea\|gb166\|EH734375 | 547 | 112 | 87.7 | blastp |
| 227 | BDL83_H19 | cichorium\|gb171\|EH680019 | 548 | 112 | 88 | blastp |
| 228 | BDL83_H20 | citrus\|gb166\|CV885954 | 549 | 112 | 89.15 | tblastn |
| 229 | BDL83_H21 | coffea\|gb157.2\|DV685589 | 550 | 112 | 87.1 | tblastn |
| 230 | BDL83_H22 | cotton\|gb164\|AI725778 | 551 | 112 | 86.8 | blastp |
| 231 | BDL83_H23 | cotton\|gb164\|CA993334 | 552 | 112 | 88.3 | blastp |
| 232 | BDL83_H24 | cowpea\|gb166\|FF537383 | 553 | 112 | 87.7 | blastp |
| 233 | BDL83_H25 | cynara\|gb167\|GE584395 | 554 | 112 | 84.16 | tblastn |
| 234 | BDL83_H26 | dandelion\|gb161\|DY806919 | 555 | 112 | 87.1 | blastp |
| 235 | BDL83_H27 | eucalyptus\|gb166\|CB967649 | 556 | 112 | 88 | blastp |
| 236 | BDL83_H28 | fescue\|gb161\|DT696580 | 557 | 112 | 82.8 | blastp |
| 237 | BDL83_H29 | ginger\|gb164\|DY345757 | 558 | 112 | 86.5 | blastp |
| 238 | BDL83_H30 | grape\|gb160\|CD008185 | 559 | 112 | 86.8 | blastp |
| 239 | BDL83_H31 | iceplant\|gb164\|CA833792 | 560 | 112 | 87.1 | blastp |
| 240 | BDL83_H32 | ipomoea\|gb157.2\|CJ755528 | 561 | 112 | 86.8 | blastp |
| 241 | BDL83_H33 | lettuce\|gb157.2\|AF162206 | 562 | 112 | 87.7 | blastp |
| 242 | BDL83_H34 | leymus\|gb166\|EG375854 | 563 | 112 | 84 | blastp |
| 243 | BDL83_H35 | lovegrass\|gb167\|DN481848 | 564 | 112 | 82.8 | blastp |

TABLE 16-continued

Homologous polynucleotides and polypeptides

| Polynuc. SEQ ID NO: | Gene Name | Organism/Cluster name | Polypep. SEQ ID NO: | Homol. to SEQ ID NO: | % Global identity | Algor. |
|---|---|---|---|---|---|---|
| 244 | BDL83_H36 | maize\|gb170\|BG355384 | 565 | 112 | 83 | blastp |
| 245 | BDL83_H37 | maize\|gb170\|LLAI603703 | 566 | 112 | 83.5 | blastp |
| 246 | BDL83_H38 | medicago\|gb157.2\|AL386990 | 567 | 112 | 80.5 | blastp |
| 247 | BDL83_H39 | medicago\|gb157.2\|AW695293 | 568 | 112 | 84.8 | blastp |
| 248 | BDL83_H40 | papaya\|gb165\|EX248440 | 569 | 112 | 84.5 | blastp |
| 249 | BDL83_H41 | peanut\|gb171\|EE126296 | 570 | 112 | 86.8 | blastp |
| 250 | BDL83_H42 | peanut\|gb171\|ES752783 | 571 | 112 | 85.9 | blastp |
| 251 | BDL83_H43 | pepper\|gb171\|CO907209 | 572 | 112 | 86.8 | blastp |
| 252 | BDL83_H44 | pepper\|gb171\|GD064098 | 573 | 112 | 87.4 | blastp |
| 253 | BDL83_H45 | physcomitrella\|gb157\|BJ157670 | 574 | 112 | 82.4 | blastp |
| 254 | BDL83_H46 | physcomitrella\|gb157\|BJ171093 | 575 | 112 | 83.63 | tblastn |
| 255 | BDL83_H47 | pine\|gb157.2\|AW010114 | 576 | 112 | 82.7 | blastp |
| 256 | BDL83_H48 | pine\|gb157.2\|CO169305 | 577 | 112 | 86.2 | blastp |
| 257 | BDL83_H49 | poplar\|gb170\|BI068614 | 578 | 112 | 88 | blastp |
| 258 | BDL83_H50 | poplar\|gb170\|BU878945 | 579 | 112 | 86.05 | tblastn |
| 259 | BDL83_H51 | potato\|gb157.2\|BF053889 | 580 | 112 | 86.2 | blastp |
| 260 | BDL83_H52 | prunus\|gb167\|DW341878 | 581 | 112 | 88.9 | blastp |
| 261 | BDL83_H53 | radish\|gb164\|EV537348 | 582 | 112 | 95 | blastp |
| 262 | BDL83_H54 | radish\|gb164\|EV565372 | 583 | 112 | 94.7 | blastp |
| 263 | BDL83_H55 | rice\|gb170\|OS01G64660 | 584 | 112 | 84.5 | blastp |
| 264 | BDL83_H56 | rice\|gb170\|OS05G36270 | 585 | 112 | 83.3 | blastp |
| 265 | BDL83_H57 | sorghum\|gb161.crp\|AW566083 | 586 | 112 | 84.8 | blastp |
| 266 | BDL83_H58 | sorghum\|gb161.crp\|AW671091 | 587 | 112 | 83.6 | blastp |
| 267 | BDL83_H59 | soybean\|gb168\|AL388391 | 588 | 112 | 81.3 | blastp |
| 268 | BDL83_H60 | soybean\|gb168\|BE941320 | 589 | 112 | 86.5 | blastp |
| 269 | BDL83_H61 | soybean\|gb168\|BF636881 | 590 | 112 | 87.1 | blastp |
| 270 | BDL83_H62 | soybean\|gb168\|CD394856 | 591 | 112 | 86.2 | blastp |
| 271 | BDL83_H63 | spikemoss\|gb165\|FE443631 | 592 | 112 | 83.9 | blastp |
| 272 | BDL83_H64 | spruce\|gb162\|CO227794 | 593 | 112 | 87.4 | blastp |
| 273 | BDL83_H65 | spruce\|gb162\|CO238226 | 594 | 112 | 83.3 | blastp |
| 274 | BDL83_H66 | spurge\|gb161\|DV121804 | 595 | 112 | 87.4 | blastp |
| 275 | BDL83_H67 | strawberry\|gb164\|DY671211 | 596 | 112 | 87.4 | blastp |
| 276 | BDL83_H68 | sugarcane\|gb157.3\|BQ533620 | 597 | 112 | 85.4 | blastp |
| 277 | BDL83_H69 | sunflower\|gb162\|BU672090 | 598 | 112 | 84.2 | blastp |
| 278 | BDL83_H70 | sunflower\|gb162\|CD847711 | 599 | 112 | 87.7 | blastp |
| 279 | BDL83_H71 | switchgrass\|gb167\|DN143181 | 600 | 112 | 84.8 | blastp |
| 280 | BDL83_H72 | switchgrass\|gb167\|DN148413 | 601 | 112 | 82.4 | tblastn |
| 281 | BDL83_H73 | tomato\|gb164\|AI486777 | 602 | 112 | 88.3 | blastp |
| 282 | BDL83_H74 | tomato\|gb164\|BG123415 | 603 | 112 | 85.9 | blastp |
| 283 | BDL83_H75 | triphysaria\|gb164\|EY166297 | 604 | 112 | 85.9 | blastp |
| 284 | BDL83_H76 | triphysaria\|gb164\|EY169717 | 605 | 112 | 87.4 | blastp |
| 285 | BDL83_H77 | wheat\|gb164\|BE213261 | 606 | 112 | 82.8 | blastp |
| 286 | BDL83_H78 | wheat\|gb164\|BE418868 | 607 | 112 | 82.8 | blastp |
| 287 | BDL83_H79 | wheat\|gb164\|BE500460 | 608 | 112 | 82.8 | blastp |
| 288 | BDL118_H0 | castorbean\|gb160\|MDL29877M000477 | 609 | 114 | 81.4 | blastp |
| 289 | BDL118_H1 | poplar\|gb170\|AI164922 | 610 | 114 | 81.3 | blastp |
| 290 | BDL118_H2 | poplar\|gb170\|BI138300 | 611 | 114 | 82 | blastp |
| 291 | BDL118_H3 | soybean\|gb168\|BE658051 | 612 | 114 | 80.1 | blastp |
| 292 | BDL118_H4 | soybean\|gb168\|CB540069 | 613 | 114 | 80 | blastp |
| 293 | BDL138_H0 | canola\|gb161\|CD817345 | 614 | 116 | 92.5 | blastp |
| 294 | BDL138_H1 | radish\|gb164\|EV536083 | 615 | 116 | 91.8 | blastp |
| 295 | BDL138_H2 | radish\|gb164\|EW725583 | 616 | 116 | 91.1 | blastp |
| 296 | BDL147_H0 | thellungiella\|gb167\|BY818222 | 617 | 118 | 81.6 | blastp |
| 297 | BDL149_H0 | b_rapa\|gb162\|DY009670 | 618 | 119 | 87.9 | blastp |
| 298 | BDL149_H1 | canola\|gb161\|CD818601 | 619 | 119 | 88.5 | blastp |
| 299 | BDL149_H2 | cowpea\|gb166\|FF400239 | 620 | 119 | 82.4 | blastp |
| 300 | BDL154_H0 | b_rapa\|gb162\|EX046206 | 621 | 122 | 90.77 | tblastn |
| 301 | BDL154_H1 | canola\|gb161\|CD841052 | 622 | 122 | 92.25 | tblastn |
| 302 | BDL155_H0 | arabidopsis\|gb165\|AT1G24240 | 623 | 123 | 92.9 | blastp |
| 303 | BDL155_H1 | arabidopsis\|gb165\|AT5G11750 | 624 | 123 | 91.7 | blastp |
| 304 | BDL155_H2 | canola\|gb161\|EE462449 | 625 | 123 | 81.3 | blastp |
| 305 | BDL155_H3 | radish\|gb164\|EV545009 | 626 | 123 | 80.34 | tblastn |
| 306 | BDL155_H4 | radish\|gb164\|EV569478 | 627 | 123 | 80.4 | blastp |
| 307 | BDL158_H0 | radish\|gb164\|EW715818 | 628 | 126 | 88.46 | tblastn |
| 308 | BDL160_H0 | canola\|gb161\|EE418738 | 629 | 127 | 83.9 | blastp |
| 309 | BDL160_H1 | radish\|gb164\|EV545765 | 630 | 127 | 85.1 | blastp |
| 310 | BDL167_H0 | radish\|gb164\|EV535056 | 631 | 196 | 82.7 | tblastn |
| 311 | BDL168_H0 | radish\|gb164\|EV525399 | 632 | 132 | 90.5 | blastp |
| 312 | BDL171_H0 | arabidopsis\|gb165\|AT2G31580 | 633 | 134 | 84 | blastp |
| 313 | BDL182_H0 | canola\|gb161\|CX188804 | 634 | 140 | 87.5 | blastp |
| 314 | BDL183_H0 | arabidopsis\|gb165\|AT4G15630 | 635 | 141 | 81.6 | blastp |
| 315 | BDL183_H1 | b_rapa\|gb162\|EE526726 | 636 | 141 | 83.7 | blastp |
| 316 | BDL183_H2 | canola\|gb161\|CD811977 | 637 | 141 | 80 | blastp |
| 317 | BDL183_H3 | canola\|gb161\|CN735162 | 638 | 141 | 83.7 | blastp |

TABLE 16-continued

Homologous polynucleotides and polypeptides

| Polynuc. SEQ ID NO: | Gene Name | Organism/Cluster name | Polypep. SEQ ID NO: | Homol. to SEQ ID NO: | % Global identity | Algor. |
|---|---|---|---|---|---|---|
| 318 | BDL183_H4 | canola\|gb161\|CN828640 | 639 | 141 | 83.7 | blastp |
| 319 | BDL183_H5 | radish\|gb164\|EW722612 | 640 | 141 | 83.2 | blastp |
| 320 | BDL183_H6 | radish\|gb164\|EX753993 | 641 | 141 | 81.6 | blastp |
| 321 | BDL183_H7 | thellungiella\|gb167\|BY824379 | 642 | 141 | 80 | blastp |
| 322 | BDL190_H0 | b_oleracea\|gb161\|AM395197 | 643 | 146 | 84.49 | tblastn |
| 323 | BDL190_H1 | canola\|gb161\|EE407003 | 644 | 146 | 87.2 | blastp |
| 324 | BDL190_H2 | radish\|gb164\|EV547395 | 645 | 146 | 86.6 | blastp |
| 325 | BDL190_H3 | thellungiella\|gb167\|BY827749 | 646 | 146 | 89.8 | blastp |
| 326 | BDL192_H0 | canola\|gb161\|CD827541 | 647 | 147 | 80.37 | tblastn |
| 327 | BDL201_H0 | b_juncea\|gb164\|EVGN00584109703185 | 648 | 153 | 81.8 | blastp |
| 328 | BDL201_H1 | b_oleracea\|gb161\|DY014784 | 649 | 153 | 80.4 | blastp |
| 329 | BDL201_H2 | b_oleracea\|gb161\|DY015288 | 650 | 153 | 82.2 | blastp |
| 330 | BDL201_H3 | b_rapa\|gb162\|BQ791239 | 651 | 153 | 83.2 | blastp |
| 331 | BDL201_H4 | canola\|gb161\|BQ704590 | 652 | 153 | 81.7 | blastp |
| 332 | BDL201_H5 | canola\|gb161\|CD822183 | 653 | 153 | 80.8 | blastp |
| 333 | BDL201_H6 | canola\|gb161\|CD838597 | 654 | 153 | 81.8 | blastp |
| 334 | BDL201_H7 | radish\|gb164\|EV527287 | 655 | 153 | 81.6 | blastp |
| 335 | BDL201_H8 | radish\|gb164\|EV534907 | 656 | 153 | 81.8 | blastp |
| 336 | BDL201_H9 | radish\|gb164\|EV543313 | 657 | 153 | 81.3 | blastp |
| 337 | BDL201_H10 | radish\|gb164\|EV565783 | 658 | 153 | 81.9 | blastp |
| 338 | BDL201_H11 | thellungiella\|gb167\|BY814893 | 659 | 153 | 83.89 | tblastn |
| 339 | BDL223_H0 | arabidopsis\|gb165\|AT3G54080 | 660 | 159 | 82.05 | tblastn |
| 340 | BDL223_H1 | arabidopsis\|gb165\|AT3G54085 | 661 | 159 | 82.1 | blastp |
| 341 | BDL223_H2 | b_juncea\|gb164\|EVGN01441114591370 | 662 | 159 | 96.15 | tblastn |
| 342 | BDL223_H3 | b_juncea\|gb164\|EVGN05602102561055 | 663 | 159 | 85 | blastp |
| 343 | BDL223_H4 | b_oleracea\|gb161\|EE534959 | 664 | 159 | 96.2 | blastp |
| 344 | BDL223_H5 | b_oleracea\|gb161\|ES947677 | 665 | 159 | 94.9 | blastp |
| 345 | BDL223_H6 | b_rapa\|gb162\|EE527700 | 666 | 159 | 96.2 | blastp |
| 346 | BDL223_H7 | canola\|gb161\|CD812251 | 667 | 159 | 96.2 | blastp |
| 347 | BDL223_H8 | canola\|gb161\|CN734091 | 668 | 159 | 96.15 | tblastn |
| 348 | BDL223_H9 | canola\|gb161\|DY007214 | 669 | 159 | 96.15 | tblastn |
| 349 | BDL223_H10 | canola\|gb161\|EG019597 | 670 | 159 | 97.4 | blastp |
| 350 | BDL223_H11 | canola\|gb161\|ES992154 | 671 | 159 | 97.4 | blastp |
| 351 | BDL223_H12 | canola\|gb161\|EV087632 | 672 | 159 | 97.4 | blastp |
| 352 | BDL223_H13 | radish\|gb164\|EV524950 | 673 | 159 | 96.15 | tblastn |
| 353 | BDL223_H14 | radish\|gb164\|EY899056 | 674 | 159 | 96.2 | blastp |
| 354 | BDL229_H0 | b_rapa\|gb162\|EX066757 | 675 | 160 | 83.5 | blastp |
| 355 | BDL229_H1 | radish\|gb164\|EW725388 | 676 | 160 | 82.59 | tblastn |
| 356 | BDL231_H0 | arabidopsis\|gb165\|AT1G79470 | 677 | 162 | 84.5 | blastp |
| 357 | BDL231_H1 | canola\|gb161\|CD826885 | 678 | 162 | 84.7 | blastp |
| 358 | BDL231_H2 | canola\|gb161\|CD827559 | 679 | 162 | 95.42 | tblastn |
| 359 | BDL242_H0 | radish\|gb164\|EV539529 | 680 | 164 | 85.9 | blastp |
| 360 | BDL247_H0 | b_oleracea\|gb161\|DY026136 | 681 | 167 | 90.82 | tblastn |
| 361 | BDL247_H1 | b_rapa\|gb162\|AY185359 | 682 | 167 | 91.1 | blastp |
| 362 | BDL247_H2 | canola\|gb161\|CD838112 | 683 | 167 | 89.1 | blastp |
| 363 | BDL247_H3 | canola\|gb161\|EE455228 | 684 | 167 | 91.1 | blastp |
| 364 | BDL247_H4 | maize\|gb170\|LLEU940833 | 685 | 167 | 92.8 | blastp |
| 365 | BDL247_H5 | radish\|gb164\|EV566311 | 686 | 167 | 92.6 | blastp |
| 366 | BDL247_H6 | thellungiella\|gb167\|DN773706 | 687 | 167 | 93.08 | tblastn |
| 367 | BDL248_H0 | arabidopsis\|gb165\|AT4G37340 | 688 | 168 | 80.6 | blastp |
| 368 | BDL70_H0 | arabidopsis\|gb165\|AT4G25960 | 689 | 201 | 80.6 | blastp |
| 369 | BDL70_H1 | poplar\|gb170\|CN192983 | 690 | 201 | 82.8 | blastp |
| 370 | BDL70_H2 | soybean\|gb168\|BE822547 | 691 | 201 | 81.9 | blastp |
| 371 | BDL70_H3 | soybean\|gb168\|CD415929 | 692 | 201 | 81.8 | blastp |
| 372 | BDL85_H0 | b_oleracea\|gb161\|AM385973 | 693 | 175 | 83.3 | blastp |
| 373 | BDL85_H1 | b_rapa\|gb162\|CV544456 | 694 | 175 | 83.3 | blastp |
| 374 | BDL85_H2 | b_rapa\|gb162\|EE523194 | 695 | 175 | 84.7 | blastp |
| 375 | BDL85_H3 | canola\|gb161\|CD813661 | 696 | 175 | 83.3 | blastp |
| 376 | BDL85_H4 | canola\|gb161\|CD822271 | 697 | 175 | 84.7 | blastp |
| 377 | BDL85_H5 | canola\|gb161\|CX280350 | 698 | 175 | 83.3 | blastp |
| 378 | BDL85_H6 | radish\|gb164\|EV527759 | 699 | 175 | 82.2 | blastp |
| 379 | BDL85_H7 | thellungiella\|gb167\|DN779034 | 700 | 175 | 83.6 | blastp |
| 380 | BDL88_H0 | barley\|gb157.3\|BI950587 | 701 | 176 | 82.3 | blastp |
| 381 | BDL88_H1 | barley\|gb157.3\|BI955547 | 702 | 176 | 88.6 | blastp |
| 382 | BDL88_H2 | brachypodium\|gb169\|BE425841 | 703 | 176 | 82.7 | blastp |
| 383 | BDL88_H3 | brachypodium\|gb169\|BM817094 | 704 | 176 | 90 | blastp |
| 384 | BDL88_H4 | fescue\|gb161\|CK802755 | 705 | 176 | 88.7 | blastp |
| 385 | BDL88_H5 | leymus\|gb166\|EG378145 | 706 | 176 | 83.2 | blastp |
| 386 | BDL88_H6 | maize\|gb170\|AI622555 | 707 | 176 | 89.9 | blastp |
| 387 | BDL88_H7 | maize\|gb170\|AI712236 | 708 | 176 | 89.2 | blastp |
| 388 | BDL88_H8 | maize\|gb170\|AI855432 | 709 | 176 | 80.7 | blastp |
| 389 | BDL88_H9 | pseudoroegneria\|gb167\|FF342352 | 710 | 176 | 88 | blastp |
| 390 | BDL88_H10 | pseudoroegneria\|gb167\|FF342444 | 711 | 176 | 82.3 | blastp |

TABLE 16-continued

Homologous polynucleotides and polypeptides

| Polynuc. SEQ ID NO: | Gene Name | Organism/Cluster name | Polypep. SEQ ID NO: | Homol. to SEQ ID NO: | % Global identity | Algor. |
|---|---|---|---|---|---|---|
| 391 | BDL88_H11 | rice\|gb170\|OS08G43320 | 712 | 176 | 84.5 | blastp |
| 392 | BDL88_H12 | sorghum\|gb161.crp\|AW562977 | 713 | 176 | 81.4 | blastp |
| 393 | BDL88_H13 | sorghum\|gb161.crp\|BE129901 | 714 | 176 | 91.1 | blastp |
| 394 | BDL88_H14 | sugarcane\|gb157.3\|SCFMEMPRO | 715 | 176 | 91.4 | blastp |
| 395 | BDL88_H15 | switchgrass\|gb167\|DN144780 | 716 | 176 | 91.7 | blastp |
| 396 | BDL88_H16 | switchgrass\|gb167\|FE629824 | 717 | 176 | 92 | blastp |
| 397 | BDL88_H17 | wheat\|gb164\|BE406463 | 718 | 176 | 88 | blastp |
| 398 | BDL88_H18 | wheat\|gb164\|BE425841 | 719 | 176 | 82 | blastp |
| 399 | BDL88_H19 | wheat\|gb164\|BF474328 | 720 | 176 | 81.2 | blastp |
| 400 | BDL88_H20 | wheat\|gb164\|BQ484144 | 721 | 176 | 87.7 | blastp |
| 401 | BDL88_H21 | wheat\|gb164\|CA599299 | 722 | 176 | 88 | blastp |
| 402 | BDL94_H0 | rice\|gb170\|OS01G09220 | 723 | 177 | 96.7 | blastp |
| 403 | BDL102_H0 | avocado\|gb164\|CK767108 | 724 | 178 | 80.69 | tblastn |
| 404 | BDL102_H1 | banana\|gb167\|FL650176 | 725 | 178 | 82.8 | blastp |
| 405 | BDL102_H2 | banana\|gb167\|FL657720 | 726 | 178 | 80.4 | blastp |
| 406 | BDL102_H3 | banana\|gb167\|FL658383 | 727 | 178 | 83.4 | blastp |
| 407 | BDL102_H4 | barley\|gb157.3\|BE215743 | 728 | 178 | 84.83 | tblastn |
| 408 | BDL102_H5 | barley\|gb157.3\|BE411917 | 729 | 178 | 85.2 | blastp |
| 409 | BDL102_H6 | barley\|gb157.3\|BF627967 | 730 | 178 | 82.76 | tblastn |
| 410 | BDL102_H7 | brachypodium\|gb169\|BE398478 | 731 | 178 | 83.7 | blastp |
| 411 | BDL102_H8 | brachypodium\|gb169\|BE399017 | 732 | 178 | 87.6 | blastp |
| 412 | BDL102_H9 | brachypodium\|gb169\|BE423566 | 733 | 178 | 85.5 | blastp |
| 413 | BDL102_H10 | cenchrus\|gb166\|EB655509 | 734 | 178 | 89 | blastp |
| 414 | BDL102_H11 | cichorium\|gb171\|DT211967 | 735 | 178 | 80.1 | blastp |
| 415 | BDL102_H12 | cichorium\|gb171\|EH700664 | 736 | 178 | 80 | blastp |
| 416 | BDL102_H13 | citrus\|gb166\|BE208879 | 737 | 178 | 80 | blastp |
| 417 | BDL102_H14 | clover\|gb162\|BB906663 | 738 | 178 | 80 | blastp |
| 418 | BDL102_H15 | cowpea\|gb166\|FC462243 | 739 | 178 | 80.7 | blastp |
| 419 | BDL102_H16 | dandelion\|gb161\|DY813750 | 740 | 178 | 80.7 | blastp |
| 420 | BDL102_H17 | fescue\|gb161\|DT685902 | 741 | 178 | 85.6 | blastp |
| 421 | BDL102_H18 | ginger\|gb164\|DY369602 | 742 | 178 | 80.7 | blastp |
| 422 | BDL102_H19 | ipomoea\|gb157.2\|BJ557023 | 743 | 178 | 80 | tblastn |
| 423 | BDL102_H20 | ipomoea\|gb157.2\|BU690707 | 744 | 178 | 80 | tblastn |
| 424 | BDL102_H21 | lettuce\|gb157.2\|DW044786 | 745 | 178 | 80 | blastp |
| 425 | BDL102_H22 | lettuce\|gb157.2\|DW050757 | 746 | 178 | 80 | tblastn |
| 426 | BDL102_H23 | lettuce\|gb157.2\|DW108809 | 747 | 178 | 81.38 | tblastn |
| 427 | BDL102_H24 | lettuce\|gb1570.2\|DW108810 | 748 | 178 | 80 | tblastn |
| 428 | BDL102_H25 | liquorice\|gb171\|FS238664 | 749 | 178 | 80.7 | blastp |
| 429 | BDL102_H26 | liquorice\|gb171\|FS241892 | 750 | 178 | 80 | tblastn |
| 430 | BDL102_H27 | liriodendron\|gb166\|CK766596 | 751 | 178 | 83.4 | blastp |
| 431 | BDL102_H28 | lotus\|gb157.2\|AW720301 | 752 | 178 | 82.1 | blastp |
| 432 | BDL102_H29 | lotus\|gb157.2\|CN825142 | 753 | 178 | 81.5 | blastp |
| 433 | BDL102_H30 | loyegrass\|gb167\|EH188388 | 754 | 178 | 88.97 | tblastn |
| 434 | BDL102_H31 | maize\|gb170\|AI391795 | 755 | 178 | 95.2 | blastp |
| 435 | BDL102_H32 | maize\|gb170\|LLBE510254 | 756 | 178 | 95.2 | blastp |
| 436 | BDL102_H33 | melon\|gb165\|DV632852 | 757 | 178 | 80 | tblastn |
| 437 | BDL102_H34 | millet\|gb161\|CD725312 | 758 | 178 | 85.7 | blastp |
| 438 | BDL102_H35 | nuphar\|gb166\|CV003178 | 759 | 178 | 81.4 | blastp |
| 439 | BDL102_H36 | oat\|gb164\|CN815719 | 760 | 178 | 91.03 | tblastn |
| 440 | BDL102_H37 | oil_palm\|gb166\|EL681098 | 761 | 178 | 86.21 | tblastn |
| 441 | BDL102_H38 | oil_palm\|gb166\|EL682630 | 762 | 178 | 84.1 | blastp |
| 442 | BDL102_H39 | oil_palm\|gb166\|EL684119 | 763 | 178 | 82.1 | blastp |
| 443 | BDL102_H40 | onion\|gb162\|CF446214 | 764 | 178 | 80.4 | blastp |
| 444 | BDL102_H41 | papaya\|gb165\|EX258155 | 765 | 178 | 80.7 | blastp |
| 445 | BDL102_H42 | pineapple\|gb157.2\|DT336701 | 766 | 178 | 84.8 | blastp |
| 446 | BDL102_H43 | pineapple\|gb157.2\|DT338401 | 767 | 178 | 84.8 | blastp |
| 447 | BDL102_H44 | poppy\|gb166\|FE964559 | 768 | 178 | 80 | tblastn |
| 448 | BDL102_H45 | rice\|gb170\|OS03G31090 | 769 | 178 | 93.8 | blastp |
| 449 | BDL102_H46 | rye\|gb164\|BE637001 | 770 | 178 | 85.2 | blastp |
| 450 | BDL102_H47 | sorghum\|gb161.crp\|AI673920 | 771 | 178 | 96.6 | blastp |
| 451 | BDL102_H48 | sorghum\|gb161.crp\|AW747023 | 772 | 178 | 83.3 | blastp |
| 452 | BDL102_H49 | soybean\|gb168\|AA661036 | 773 | 178 | 80 | blastp |
| 453 | BDL102_H50 | soybean\|gb168\|AW720301 | 774 | 178 | 80 | tblastn |
| 454 | BDL102_H51 | sugarcane\|gb157.3\|CA076952 | 775 | 178 | 96.6 | blastp |
| 455 | BDL102_H52 | sugarcane\|gb157.3\|CA087422 | 776 | 178 | 96.6 | blastp |
| 456 | BDL102_H53 | sugarcane\|gb157.3\|CA103720 | 777 | 178 | 97.2 | blastp |
| 457 | BDL102_H54 | sugarcane\|gb157.3\|CA113942 | 778 | 178 | 84.25 | tblastn |
| 458 | BDL102_H55 | sugarcane\|gb157.3\|CA114406 | 779 | 178 | 97.2 | blastp |
| 459 | BDL102_H56 | sugarcane\|gb157.3\|CA116867 | 780 | 178 | 87.6 | blastp |
| 460 | BDL102_H57 | sugarcane\|gb157.3\|CA119956 | 781 | 178 | 90.34 | tblastn |
| 461 | BDL102_H58 | sugarcane\|gb157.3\|CA128680 | 782 | 178 | 86.9 | blastp |
| 462 | BDL102_H59 | sugarcane\|gb157.3\|CA139681 | 783 | 178 | 84.3 | blastp |
| 463 | BDL102_H60 | sugarcane\|gb157.3\|CA151882 | 784 | 178 | 93.1 | tblastn |
| 464 | BDL102_H61 | sugarcane\|gb157.3\|CA153401 | 785 | 178 | 96.6 | blastp |

TABLE 16-continued

Homologous polynucleotides and polypeptides

| Polynuc. SEQ ID NO: | Gene Name | Organism/Cluster name | Polypep. SEQ ID NO: | Homol. to SEQ ID NO: | % Global identity | Algor. |
|---|---|---|---|---|---|---|
| 465 | BDL102_H62 | sugarcane\|gb157.3\|CA193794 | 786 | 178 | 97.2 | blastp |
| 466 | BDL102_H63 | sugarcane\|gb157.3\|CA215946 | 787 | 178 | 80 | blastp |
| 467 | BDL102_H64 | sugarcane\|gb157.3\|CA235573 | 788 | 178 | 80.3 | blastp |
| 468 | BDL102_H65 | sugarcane\|gb157.3\|CA241742 | 789 | 178 | 82.76 | tblastn |
| 469 | BDL102_H66 | sugarcane\|gb157.3\|CA289186 | 790 | 178 | 95.2 | blastp |
| 470 | BDL102_H67 | sugarcane\|gb157.3\|CF571967 | 791 | 178 | 93.79 | tblastn |
| 471 | BDL102_H68 | sugarcane\|gb157.3\|CF574520 | 792 | 178 | 97.2 | blastp |
| 472 | BDL102_H69 | sunflower\|gb162\|CD848588 | 793 | 178 | 80 | blastp |
| 473 | BDL102_H70 | sunflower\|gb162\|CD850971 | 794 | 178 | 80.7 | blastp |
| 474 | BDL102_H71 | switchgrass\|gb167\|DN142384 | 795 | 178 | 95.9 | blastp |
| 475 | BDL102_H72 | switchgrass\|gb167\|FE598349 | 796 | 178 | 96.6 | blastp |
| 476 | BDL102_H73 | switchgrass\|gb167\|FE608943 | 797 | 178 | 96.6 | blastp |
| 477 | BDL102_H74 | switchgrass\|gb167\|FE642870 | 798 | 178 | 96.6 | blastp |
| 478 | BDL102_H75 | switchgrass\|gb167\|FL710664 | 799 | 178 | 95.2 | blastp |
| 479 | BDL102_H76 | tea\|gb171\|FE861343 | 800 | 178 | 80.14 | tblastn |
| 480 | BDL102_H77 | walnuts\|gb166\|CV195103 | 801 | 178 | 80.7 | blastp |
| 481 | BDL102_H78 | walnuts\|gb166\|CV196374 | 802 | 178 | 80.7 | blastp |
| 482 | BDL102_H79 | wheat\|gb164\|BE398202 | 803 | 178 | 85.2 | blastp |
| 483 | BDL102_H80 | wheat\|gb164\|BE406254 | 804 | 178 | 85.2 | blastp |
| 484 | BDL102_H81 | wheat\|gb164\|BE414893 | 805 | 178 | 85.2 | blastp |
| 485 | BDL102_H82 | wheat\|gb164\|CA485952 | 806 | 178 | 96.6 | blastp |
| 486 | BDL102_H83 | wheat\|gb164\|CA486424 | 807 | 178 | 93.8 | blastp |
| 487 | BDL226_H0 | canola\|gb161\|CD835072 | 808 | 181 | 89.5 | blastp |
| 488 | BDL226_H1 | radish\|gb164\|EV568139 | 809 | 181 | 91.7 | blastp |
| 489 | BDL233_H0 | radish\|gb164\|EV549343 | 810 | 185 | 84.5 | blastp |
| 490 | BDL237_H0 | arabidopsis\|gb165\|AT2G44890 | 811 | 187 | 86.3 | blastp |
| 491 | BDL238_H0 | arabidopsis\|gb165\|AT1G32763 | 812 | 202 | 81.5 | blastp |
| 492 | BDL240_H0 | castorbean\|gb160\|MDL30174M008707 | 813 | 189 | 82.4 | blastp |
| 493 | BDL240_H1 | cotton\|gb164\|BG446934 | 814 | 189 | 81.4 | blastp |
| 494 | BDL240_H2 | soybean\|gb168\|AW329693 | 815 | 189 | 80.7 | blastp |
| 495 | BDL240_H3 | soybean\|gb168\|BE329627 | 816 | 189 | 80.1 | blastp |
| 496 | BDL241_H0 | canola\|gb161\|CN825973 | 817 | 190 | 85.3 | blastp |
| 497 | BDL249_H0 | radish\|gb164\|EW735252 | 818 | 191 | 86.7 | blastp |
| 498 | BDL251_H0 | arabidopsis\|gb165\|AT5G23190 | 819 | 192 | 80.07 | tblastn |
| 499 | BDL252_H0 | apple\|gb171\|CN489978 | 820 | 193 | 80.9 | blastp |
| 500 | BDL252_H1 | apple\|gb171\|CN883406 | 821 | 193 | 80.9 | blastp |
| 501 | BDL252_H2 | b_rapa\|gb162\|EX036871 | 822 | 193 | 91 | blastp |
| 502 | BDL252_H3 | cacao\|gb167\|CU476642 | 823 | 193 | 84.3 | blastp |
| 503 | BDL252_H4 | canola\|gb161\|CN732395 | 824 | 193 | 90.6 | blastp |
| 504 | BDL252_H5 | canola\|gb161\|ES900668 | 825 | 193 | 86.2 | blastp |
| 505 | BDL252_H6 | castorbean\|gb160\|MDL29726M003996 | 826 | 193 | 81.4 | blastp |
| 506 | BDL252_H7 | citrus\|gb166\|CB417408 | 827 | 193 | 82.8 | blastp |
| 507 | BDL252_H8 | cotton\|gb164\|AI725830 | 828 | 193 | 82.8 | blastp |
| 508 | BDL252_H9 | cotton\|gb164\|CO094656 | 829 | 193 | 82.5 | blastp |
| 509 | BDL252_H10 | cowpea\|gb166\|FC458375 | 830 | 193 | 80.5 | blastp |
| 510 | BDL252_H11 | grape\|gb160\|CB920145 | 831 | 193 | 80.5 | blastp |
| 511 | BDL252_H12 | ipomoea\|gb157.2\|AU223826 | 832 | 193 | 80.2 | blastp |
| 512 | BDL252_H13 | lettuce\|gb157.2\|DW116753 | 833 | 193 | 80.22 | tblastn |
| 513 | BDL252_H14 | medicago\|gb157.2\|AL371996 | 834 | 193 | 80.9 | blastp |
| 514 | BDL252_H15 | peach\|gb157.2\|BU039377 | 835 | 193 | 82.4 | blastp |
| 515 | BDL252_H16 | poplar\|gb170\|BU816161 | 836 | 193 | 80.7 | blastp |
| 516 | BDL252_H17 | prunus\|gb167\|BU039377 | 837 | 193 | 82.4 | blastp |
| 517 | BDL252_H18 | radish\|gb164\|EV535608 | 838 | 193 | 92.1 | blastp |
| 518 | BDL252_H19 | radish\|gb164\|EW723334 | 839 | 193 | 91.8 | blastp |
| 519 | BDL252_H20 | soybean\|gb168\|BF636462 | 840 | 193 | 80.1 | blastp |
| 520 | BDL252_H21 | soybean\|gb168\|BU546186 | 841 | 193 | 82.4 | blastp |
| 521 | BDL252_H22 | soybean\|gb168\|CD390334 | 842 | 193 | 82.4 | blastp |
| 522 | BDL252_H23 | strawberry\|gb164\|CX661379 | 843 | 193 | 82 | blastp |
| 523 | BDL252_H24 | thellungiella\|gb167\|BY812142 | 844 | 193 | 92.1 | blastp |

Table 16: Provided are polynucleotides and polypeptides which are homologous to the identified polynucleotides or polypeptides of Table 15.
Homol. = homologue;
Algor. = Algorithm;

Example 7

Gene Cloning and Generation of Binary Vectors for Plant Expression

To validate their role in improving oil content, plant yield, seed yield, biomass, growth rate, ABST, NUE and/or vigor, selected genes were over-expressed in plants, as follows.

Cloning Strategy

Genes listed in Examples 5 and 6 hereinabove were cloned into binary vectors for the generation of transgenic plants. For cloning, the full-length open reading frame (ORF) was first identified. In case of ORF-EST clusters and in some cases already published mRNA sequences were analyzed to identify the entire open reading frame by comparing the results of several translation algorithms to known proteins from other plant species. To clone the full-length cDNAs, reverse transcription (RT) followed by polymerase chain reaction (PCR; RT-PCR) was performed on total RNA extracted from leaves, flowers, siliques or other plant tissues, growing under normal conditions. Total RNA was extracted as described in Example 2 above. Production of cDNA and PCR amplification was performed using standard protocols described elsewhere (Sambrook J., E. F. Fritsch, and T. Maniatis. 1989. Molecular Cloning. A Laboratory Manual., 2nd Ed. Cold Spring Harbor Laboratory Press, New York.) which are well known to those skilled in the art. PCR products were purified using PCR purification kit (Qiagen). In case where the entire coding sequence was not found, RACE kit from Ambion, Clontech or Invitrogen (RACE=Rapid Access to cDNA Ends) was used to access the full cDNA transcript of the gene from the RNA samples described above. The RACE procedure was performed for the genes BDL197 (SEQ ID NO:46), BDL156 (SEQ ID NO:19), BDL169 (SEQ ID NO:28), BDL189 (SEQ ID NO:40), BDL200 (SEQ ID NO:47), BDL79 (SEQ ID NO:5), BDL231 (SEQ ID NO:57), BDL238 (SEQ ID NO:84) and BDL248 (SEQ ID NO:103) using the primers sequences listed in Table 17, below. RACE products were cloned into high copy vector followed by sequencing or directly sequenced. RACE products were sequenced as described hereinbelow for the genes specified in Table 17.

The information from the RACE procedure was used for cloning of the full length ORF of the corresponding genes.

TABLE 17

RACE primers used for sequencing of the identified genes of the invention

| Gene Name | Primers used for amplification | High copy plasmid used for cloning of RACE products |
|---|---|---|
| BDL197_5'Race | BDL197_NGSP1_R2 (SEQ ID NO: 934) (CGCCTGAAGCTTCTCCGAGAAC) | TopoTA |
| BDL156_5'Race | BDL156_NGSP1_R (SEQ ID NO: 937) (ACGGTGTTTCCAGAATTTCGCAG) | |
| BDL156_3'Race | BDL156_NGSP2_F (SEQ ID NO: 938) (CTGAATGTGACTGGGATATGTCGG) | TopoTA |
| BDL169_5'Race | BDL169_NGSP1_R (SEQ ID NO: 939) (TGCACTGGAGCGTGTAGGGACAG) | |
| BDL169_3'Race | BDL169_NGSP1_F (SEQ ID NO: 940) (GGCAGAAACTGTTTTATGGAAATGG) | |
| BDL189_5'Race | BDL189_NGSP1_R (SEQ ID NO: 941) (TTCTGTCCCTCGACCAAGGTTG) | TopoTA |
| BDL189_3'Race | BDL189_GSP2-F (SEQ ID NO: 942) (CAGTCAATCTTCTTAGCATCGCTGAG) | |
| BDL200_5'Race | BDL200_NGSP_Rb (SEQ ID NO: 943) (CCAATGCCAATACGATGGTCGG) | TopoTA |
| BDL200_3'Race | BDL200_NGSP2_F (SEQ ID NO: 944) (GAGCTTTGGAGATAAGATTGGTGCAG) | |
| BDL79_5'Race | BDL79_GSP1_R (SEQ ID NO: 945) (GTATCACTCGAGGCACCATTGGG) | TopoTA |
| BDL231_3'Race | BDL231 NGSP R (SEQ ID NO: 946) (ATGTGGGATTCCGAGACAGTGTCC) | TopoTA |
| BDL238_5'Race | BDL238 NGSP R (SEQ ID NO: 947) (TTTACCGTCCCCAAACGTTGCCG) | |
| BDL238_3'Race | BDL238 NGSP F (SEQ ID NO: 948) (CTCATCCGGACGATGTCTTACTTCTTCTCC) | |
| BDL248_5'Race | BDL248 NGSP R (SEQ ID NO: 949) (GAGGTGACCGATCACTGGTAACGC) | |

TABLE 17-continued

RACE primers used for sequencing of the identified genes of the invention

| Gene Name | Primers used for amplification | High copy plasmid used for cloning of RACE products |
|---|---|---|
| BDL215_5'Race | BDL215_NGSP1_R (SEQ ID NO: 950) (TGGCTTTGAAAACGTAACATGCC) | |
| BDL215_3'Race | BDL215_NGSP2_F (SEQ ID NO: 951) (TATTGGGATTTTCGGATCGATGG) | TopoTA |

Table 17. Provided are the PCR primers used for RACE sequencing. Fwd = forward primer; Rev = reverse primer;

In case genomic DNA was cloned, as in the case of BDL90 and BDL94 the genes were amplified by direct PCR on genomic DNA extracted from leaf tissue using the DNAeasy kit (Qiagen Cat. No. 69104).

Usually, 2 sets of primers were synthesized for the amplification of each gene from a cDNA or a genomic sequence; an external set of primers and an internal set (nested PCR primers). When needed (e.g., when the first PCR reaction did not result in a satisfactory product for sequencing), an additional primer (or two) of the nested PCR primers were used. Table 18 below provides primers used for cloning of selected genes.

TABLE 18

The PCR primers used for cloning the genes of the invention

| Gene Name | Restriction Enzymes used for cloning | Primers used for amplification |
|---|---|---|
| BDL102 | SalI, XbaI | BDL102_NF_SalI (SEQ ID NO: 952) AATGTCGACTACCTGCCTTTCTCTCGTCC BDL102_EF_SalI (SEQ ID NO: 953) AAAGTCGACACTCTACCTGCCTTTCTCTCG BDL102_NR_XbaI (SEQ ID NO: 954) ATTCTAGACTATGTAGCCATCTCAACAATCAAAC BDL102_ER_XbaI (SEQ ID NO: 955) ATTCTAGAGGTTTTGATAAATAGGTACTCAGG |
| BDL117 | | BDL117_EF_SmaI (SEQ ID NO: 956) CCCCGGGTCTCGGAGGTATCTTATTCCAG BDL117_ER_SmaI (SEQ ID NO: 957) CCCCGGGATGCCACACTTAAGGCCAAG |
| BDL118 | SmaI, SmaI | BDL118_NF_SmaI (SEQ ID NO: 958) TCCCGGGTCTGGGTCTACTTTTGATTTGAG BDL118_NR_SmaI (SEQ ID NO: 959) TCCCGGGTGAAGCAGAAGTTTCGATTTAAG |
| BDL138 | SalI, XbaI | BDL138_NF_SalI (SEQ ID NO: 960) AAAGTCGACCGAATCGTAATTGTTGAAGAGAG BDL138_EF_SalI (SEQ ID NO: 961) ATTGTCGACTTTAAGGAGAAGAGTCGCAGTC BDL138_NR_XbaI (SEQ ID NO: 962) ATTCTAGATTAGAGAGTGGTTGATAACGCAGAG BDL138_ER_XbaI (SEQ ID NO: 963) ACTCTAGACTACCTGTCACAATTTTCTAAAACAC |

TABLE 18-continued

The PCR primers used for cloning the genes of the invention

| Gene Name | Restriction Enzymes used for cloning | Primers used for amplification |
|---|---|---|
| BDL140 | XbaI, SacI | BDL140_NF_XbaI<br>(SEQ ID NO: 964)<br>TATCTAGATTGAGAATGAACTCAGTGTGTATC<br>BDL140_EF_XbaI<br>(SEQ ID NO: 965)<br>AATCTAGAAACTAAACATTGAGAATGAACTCAG<br>BDL140_NR_SacI<br>(SEQ ID NO: 966)<br>TGAGCTCTTAAGTCATTTAGTTTGGATCAACAAC<br>BDL140_ER_SacI<br>(SEQ ID NO: 967)<br>CGAGCTCAGACCATGCATTTAAGGATCAC |
| BDL147 | SalI, XbaI | BDL147_NF_SalI<br>(SEQ ID NO: 968)<br>TTAGTCGACCACAGTAACCATGTCCGTCTC<br>BDL147_NR_XbaI<br>(SEQ ID NO: 969)<br>TATCTAGAGTGCTGCTTACTCGCTGTTTC |
| BDL149 | SalI, XbaI | BDL149_NF_SalI<br>(SEQ ID NO: 970)<br>AAAGTCGACCTCAAACCCAAGAACCTCATC<br>BDL149_NR_XbaI<br>(SEQ ID NO: 971)<br>ATTCTAGATGCAATAGTAGTAGCAGTGAACC |
| BDL152 | XbaI, SacI | BDL152_NF_XbaI<br>(SEQ ID NO: 972)<br>TATCTAGATTCAGACAAAAACAGAGAGAAACT<br>BDL152_NR_SacI<br>(SEQ ID NO: 973)<br>TGAGCTCCTAAGATCGGTTTAATCAATAGGG |
| BDL153 | SalI, SmaI | BDL153_NF_SalI<br>(SEQ ID NO: 974)<br>AAAGTCGACAACAGCTTCGGTTTAAGAGTTC<br>BDL153_NR_SmaI<br>(SEQ ID NO: 975)<br>TCCCGGGTCTACATTACGGCATACGGC |
| BDL154 | SalI, SacI | BDL154_NF_SalI<br>(SEQ ID NO: 976)<br>TTAGTCGACTTAAAAATGGAGAGTCAAAAGC<br>BDL154_NR_SacI<br>(SEQ ID NO: 977)<br>TGAGCTCCTACTACTTCTTGTTGATGCTGAGG |
| BDL155 | SalI, XbaI | BDL155_NF_SalI<br>(SEQ ID NO: 978)<br>AATGTCGACTCCTCTTGCGGAGAGATGC<br>BDL155_NR_XbaI<br>(SEQ ID NO: 979)<br>ATTCTAGATCTCCTTTTGAGAGAGTGCAAC |
| BDL156 | SalI, XbaI | BDL156_NF_SalI<br>(SEQ ID NO: 980)<br>AATGTCGACTCGTCGTCTTCCTCATTTCG<br>BDL156_ER_XbaI<br>(SEQ ID NO: 981)<br>ATTCTAGACTAATACGATTGGTAACAAGAAAACG |
| BDL157 | SalI, XbaI | BDL157_NF_SalI<br>(SEQ ID NO: 982)<br>ATTGTCGACTTTCAATAAGAAATCTGCGTCC<br>BDL157_EF_SalI<br>(SEQ ID NO: 983)<br>AAAGTCGACGAATCTGCTTTTAAGCTTCTCG<br>BDL157_NR_XbaI<br>(SEQ ID NO: 984)<br>ATTCTAGACTAAAGAGAGTGAAGGAACAAAGACC<br>BDL157_ER_XbaI<br>(SEQ ID NO: 985)<br>ATTCTAGACTATTTTCTTCTGTCTTCTGTGTCTTC |

TABLE 18-continued

The PCR primers used for cloning the genes of the invention

| Gene Name | Restriction Enzymes used for cloning | Primers used for amplification |
|---|---|---|
| BDL158 | | BDL158_EF_XbaI<br>(SEQ ID NO: 986)<br>AATCTAGACCTCACTTCTCTCTCTCTCTTC<br>BDL158_ER_SmaI<br>(SEQ ID NO: 987)<br>CCCCGGGAGCCTAAAGCCTAACCCAAC |
| BDL160 | SalI, XbaI | BDL160_NF_SalI<br>(SEQ ID NO: 988)<br>AAAGTCGACTGATCTACACAGAATCCATTTCC<br>BDL160_NR_XbaI<br>(SEQ ID NO: 989)<br>AATCTAGATCATTCAGCCATTCACATTTTAGG |
| BDL162 | SalI, XbaI | BDL162_NF_SalI<br>(SEQ ID NO: 990)<br>TTAGTCGACCCTAATAATGGCTTGCAGAGC<br>BDL162_NR_XbaI<br>(SEQ ID NO: 991)<br>TATCTAGAAAATCTTGAGACTAAATCAAGCTG |
| BDL167 | SalI, XbaI | BDL167_NF_SalI<br>(SEQ ID NO: 992)<br>AAAGTCGACGCAAGAAAGGGACTAACCAAG<br>BDL167_NR_XbaI<br>(SEQ ID NO: 993)<br>ACTCTAGACTATGTCGGCATTAACTTAGAATCAC |
| BDL168 | XbaI, SmaI | BDL168_NF_XbaI<br>(SEQ ID NO: 994)<br>AATCTAGACTTGCTTCAAGATTCGAGTGAG<br>BDL168_EF_XbaI<br>(SEQ ID NO: 995)<br>AATCTAGAATTAACCACCATTTCTGTGAAG<br>BDL168_NR_SmaI<br>(SEQ ID NO: 996)<br>TCCCGGGCTACCTTCCTTCTTCTTCACTTCC<br>BDL168_ER_SmaI<br>(SEQ ID NO: 997)<br>TCCCGGGTCCTAAAAGTCAGTCACCTTCTG |
| BDL169 | SalI, XbaI | BDL169_NF_SalI<br>(SEQ ID NO: 998)<br>AAAGTCGACGAAGGTGAAGTGATGGATTCTG<br>BDL169_EF_SalI<br>(SEQ ID NO: 999)<br>AATGTCGACTGTTACCGATAAGAAGGTGAAG<br>BDL169_NR_XbaI<br>(SEQ ID NO: 1000)<br>ATTCTAGACTAACAGCTTCAACGTAATTTGGTG<br>BDL169_ER_XbaI<br>(SEQ ID NO: 1001)<br>ATTCTAGATCAACGTCATTTTGTGCATATC |
| BDL173 | XbaI, SmaI | BDL173_EF_XbaI<br>(SEQ ID NO: 1002)<br>ATTCTAGATTTTCCCGAATCTATTCATCAC<br>BDL173_ER_SmaI<br>(SEQ ID NO: 1003)<br>CCCCGGGAACGCTTCACCCTTTAATCC |
| BDL174 | SalI, SacI | BDL174_NF_SalI<br>(SEQ ID NO: 1004)<br>AAAGTCGACCCGAGGAAGATGACGACAC<br>BDL174_NR_SacI<br>(SEQ ID NO: 1005)<br>TGAGCTCCTAGTTTCAAGCAAGAGTGATTCC |
| BDL176 | SmaI, SmaI | BDL176_NF_SmaI<br>(SEQ ID NO: 1006)<br>TCCCGGGTATTGAGCAGCCGTGAAATC<br>BDL176_NR_SmaI<br>(SEQ ID NO: 1007)<br>TCCCGGGTGGACCAAAGAATCAAATAGTAAC |

TABLE 18-continued

The PCR primers used for cloning the genes of the invention

| Gene Name | Restriction Enzymes used for cloning | Primers used for amplification |
|---|---|---|
| BDL177 | SalI, SacI | BDL177_NF_SalI<br>(SEQ ID NO: 1008)<br>AATGTCGACTCAGGATCTATGGGCAAGTC<br>BDL177_EF_SalI<br>(SEQ ID NO: 1009)<br>AAAGTCGACGCTTGTGATCAGGATCTATGG<br>BDL177_NR_SacI<br>(SEQ ID NO: 1010)<br>TGAGCTCCTAAACAGCTTTCTTCTACTCTTCATC<br>BDL177_ER_SacI<br>(SEQ ID NO: 1011)<br>CGAGCTCACAGAAAACAAAAGAAACTAGGC |
| BDL181 | SalI, SacI | BDL181_NF_SalI<br>(SEQ ID NO: 1012)<br>AAAGTCGACGCGATAGATCTGACGAATGC<br>BDL181_NR_SacI<br>(SEQ ID NO: 1013)<br>TGAGCTCCTAGATTTCATACTCAGGAAGCCAC |
| BDL182 | SalI, SacI | BDL182_NF_SalI<br>(SEQ ID NO: 1014)<br>AACGTCGACTCTACCATCGACAACGAGAAAC<br>BDL182_NR_SacI_new<br>(SEQ ID NO: 1015)<br>TGAGCTCCTACATTCACAACAAACCACCACTAC |
| BDL183 | SalI, XbaI | BDL183_NF_SalI<br>(SEQ ID NO: 1016)<br>AATGTCGACTTATTTTGATCTTCCTCACTTCTG<br>BDL183_EF_SalI<br>(SEQ ID NO: 1017)<br>AAAGTCGACGATCAATCTTTGTTATCTCTCACTC<br>BDL183_NR_XbaI<br>(SEQ ID NO: 1018)<br>ATTCTAGACTAATCACACAAAACGACAAGAACAG<br>BDL183_ER_XbaI<br>(SEQ ID NO: 1019)<br>ACTCTAGAACGATGTGATAAAACATTAGAAGC |
| BDL186 | SalI, XbaI | BDL186_NF_SalI<br>(SEQ ID NO: 1020)<br>AAAGTCGACCGAAGTGAAAGTCGTGATGG<br>BDL186_EF_SalI<br>(SEQ ID NO: 1021)<br>AAAGTCGACACGCAAACGTGATCCTAAAC<br>BDL186_NR_XbaI<br>(SEQ ID NO: 1022)<br>ATTCTAGACTCAAGGGGACGAGATATCAG<br>BDL186_ER_XbaI<br>(SEQ ID NO: 1023)<br>ACTCTAGAAGGTAGAGAGCATCAAGGAAGC |
| BDL187 | SalI, SmaI | BDL187_NF_SalI<br>(SEQ ID NO: 1024)<br>ATAGTCGACATTCTTTCAGTTTTCCGGTG<br>BDL187_EF_SalI<br>(SEQ ID NO: 1025)<br>AAAGTCGACGCTTGAATTCTTTCAGTTTTCC<br>BDL187_NR_SmaI<br>(SEQ ID NO: 1026)<br>TCCCGGGCTATTTTCACCAGTAATTTCCACAC<br>BDL187_ER_SmaI<br>(SEQ ID NO: 1027)<br>TCCCGGGTTACTTTAGCCACAATCTGTGTTTTC |
| BDL188 | XbaI, SmaI | BDL188_NF_XbaI<br>(SEQ ID NO: 1028)<br>AATCTAGAATTTTCATTTGTTCGCTTCG<br>BDL188_NR_SmaI<br>(SEQ ID NO: 1029)<br>TCCCGGGCTAACAGTAGGTAATTTTGACATCCAG |

TABLE 18-continued

The PCR primers used for cloning the genes of the invention

| Gene Name | Restriction Enzymes used for cloning | Primers used for amplification |
|---|---|---|
| BDL189 | | BDL189_NF_SmaI<br>(SEQ ID NO: 1030)<br>ACCCGGGCATTGCCTGTTGGCTTCG<br>BDL189_NR_SmaI<br>(SEQ ID NO: 1031)<br>ACCCGGGTTACAATACAATTGTTTAATTCGAGG |
| BDL190 | SalI, XbaI | BDL190_NF_SalI<br>(SEQ ID NO: 1032)<br>TTAGTCGACAAAATAATGGCAGCTTTGGC<br>BDL190_EF_SalI<br>(SEQ ID NO: 1033)<br>TTAGTCGACTCTCGTCACATATCTTCATCGAC<br>BDL190_NR_XbaI<br>(SEQ ID NO: 1034)<br>TATCTAGACTACTAGACAAATTTGTTGATCAATTC<br>BDL190_ER_XbaI<br>(SEQ ID NO: 1035)<br>TATCTAGACTAAAGAGAGAACTAGACAAATTTGTTG |
| BDL192 | SalI, XbaI | BDL192_NF_SalI<br>(SEQ ID NO: 1036)<br>ATTGTCGACTTTACGAAATACGCCGAATC<br>BDL192_EF_SalI<br>(SEQ ID NO: 1037)<br>AATGTCGACTTCGAAACCCTAACAAAAGC<br>BDL192_NR_XbaI<br>(SEQ ID NO: 1038)<br>ACTCTAGAATCTGCATAGCAGTTAGAACAAG<br>BDL192_ER_XbaI<br>(SEQ ID NO: 1039)<br>ATTCTAGAGAAAGGTCCTCATTCATAATCC |
| BDL193 | XbaI, SacI | BDL193_EF_XbaI<br>(SEQ ID NO: 1040)<br>AATCTAGACTTCATATTCAAATCTCCTCTCC<br>BDL193_ER_SacI<br>(SEQ ID NO: 1041)<br>CGAGCTCATCACAAACAAACCTAAGAGGC |
| BDL194 | EcoRV, EcoRV | BDL194_NF_EcoRV<br>(SEQ ID NO: 1042)<br>AAGATATCAGCCATTGTTCTTCATCATCTC<br>BDL194_NR_EcoRV<br>(SEQ ID NO: 1043)<br>ACGATATCCTAACAGGGTTTTCAGTGCTGTG |
| BDL196 | SalI, XbaI | BDL196_NF_salI<br>(SEQ ID NO: 1044)<br>TTAGTCGACAAGACATGAAGTTCATGACACTAATG<br>BDL196_EF_SalI<br>(SEQ ID NO: 1045)<br>TTAGTCGACAACTGAAACAAAAGAAGAGTCATC<br>BDL196_NR_XbaI<br>(SEQ ID NO: 1046)<br>TATCTAGATTATGAGCTTTAACAACTAGTATAAGGAAC<br>BDL196_ER_XbaI<br>(SEQ ID NO: 1047)<br>TATCTAGACACCACAATTTTAAGCTTCAAC |
| BDL197 | SalI, XbaI | BDL197_NF_SalI<br>(SEQ ID NO: 1048)<br>AAAGTCGACTGTTCTTGTTCTTCACGATGAG<br>BDL197_EF_SalI<br>(SEQ ID NO: 1049)<br>AAAGTCGACTCTAAATCCTATGTTCTTGTTCTTC<br>BDL197_NR_XbaI<br>(SEQ ID NO: 1050)<br>AATTCTAGAGGTTCAAAATACGTAACACATTG<br>BDL197_ER_XbaI<br>(SEQ ID NO: 1051)<br>AACTCTAGAACCATATTAGGTTCAAAATACGTAAC |

TABLE 18-continued

The PCR primers used for cloning the genes of the invention

| Gene Name | Restriction Enzymes used for cloning | Primers used for amplification |
|---|---|---|
| BDL201 | SalI, XbaI | BDL201_NF_SalI<br>(SEQ ID NO: 1052)<br>AAAGTCGACCGATCAACAGACTCTAATCAGC<br>BDL201_NR_XbaI<br>(SEQ ID NO: 1053)<br>ATTCTAGATTAGTTCTATACTGCAGATTCTTGGG |
| BDL203 | SalI, XbaI | BDL203_NF_SalI<br>(SEQ ID NO: 1054)<br>AATGTCGACTTCTCTCTGTTCTTGCACTCG<br>BDL203_EF_SalI<br>(SEQ ID NO: 1055)<br>AAAGTCGACCTTCTTCTTCTTTTCTCAATCTTTC<br>BDL203_NR_XbaI<br>(SEQ ID NO: 1056)<br>ATTCTAGATCTGTATCATTAAAACTGAGGAAG<br>BDL203_ER_XbaI<br>(SEQ ID NO: 1057)<br>ATTCTAGAGTGGCGAGACAACATTTCTAC |
| BDL220 | SalI, XbaI | BDL220_NF_SalI<br>(SEQ ID NO: 1058)<br>AAAGTCGACCTCTCTCTCTAATGGGTAATTG<br>BDL220_EF_SalI<br>(SEQ ID NO: 1059)<br>AATGTCGACTCACCACACAACACAACCAAG<br>BDL220_NR_XbaI<br>(SEQ ID NO: 1060)<br>ACTCTAGAAATCCAACGTCAAATGAGAAG<br>BDL220_NF_SalI<br>(SEQ ID NO: 1061)<br>AAAGTCGACCTCTCTCTCTAATGGGTAATTG |
| BDL221 | SalI, XbaI | BDL221_NF_SalI<br>(SEQ ID NO: 1062)<br>AATGTCGACTTGGATCAGAGAAAATATGTCG<br>BDL221_EF_SalI<br>(SEQ ID NO: 1063)<br>ATAGTCGACCTTGAATCTGAAGCTAATCTTGG<br>BDL221_NR_XbaI<br>(SEQ ID NO: 1064)<br>ATTCTAGATTAGCATTAGAACGGGACAGTATAAG<br>BDL221_ER_XbaI<br>(SEQ ID NO: 1065)<br>ACTCTAGATCAAAGAATCGAGCATTAGAACGG |
| BDL222 | SalI, XbaI | BDL222_NF_SalI<br>(SEQ ID NO: 1066)<br>AAAGTCGACCTAAACCGGTAAAAGATGTCG<br>BDL222_EF_SalI<br>(SEQ ID NO: 1067)<br>AACGTCGACACTTTTGTTTTGCCTTTCCTC<br>BDL222_NR_XbaI<br>(SEQ ID NO: 1068)<br>ATTCTAGATCTTCTTCATCACTCAATCGC<br>BDL222_ER_XbaI<br>(SEQ ID NO: 1069)<br>ATTCTAGACTGTGGTATTTAGGGAATACATCC |
| BDL223 | SalI, XbaI | BDL223_NF_SalI<br>(SEQ ID NO: 1070)<br>AAAGTCGACCACAGAGAAATCATGGGGTTC<br>BDL223_EF_SalI<br>(SEQ ID NO: 1071)<br>AACGTCGACAGATATCGTTGGCTTCGTCTC<br>BDL223_NR_XbaI<br>(SEQ ID NO: 1072)<br>ATTCTAGATTAGGTTTGATCATTTTAACCAGAG<br>BDL223_ER_XbaI<br>(SEQ ID NO: 1073)<br>ATTCTAGACTATGCAGAAATGTTTGGATTGAG |

TABLE 18-continued

The PCR primers used for cloning the genes of the invention

| Gene Name | Restriction Enzymes used for cloning | Primers used for amplification |
|---|---|---|
| BDL224 | XbaI, SmaI | BDL224_NF_XbaI<br>(SEQ ID NO: 1074)<br>AATCTAGACCACAAAATTCGTCAAAGCTC<br>BDL224_EF_XbaI<br>(SEQ ID NO: 1075)<br>ATTCTAGATTTTCAAACCACAAAATTCGTC<br>BDL224_NR_SmaI<br>(SEQ ID NO: 1076)<br>CCCCGGGATCCAACCAATCCCTAAAATG<br>BDL224_ER_SmaI<br>(SEQ ID NO: 1077)<br>CCCCGGGATCAGCCACTTCTACTCTCAATTC |
| BDL225 | SalI, XbaI | BDL225_NF_SalI<br>(SEQ ID NO: 1078)<br>AATGTCGACTCCTTGTGATTCATTATTTTGC<br>BDL225_EF_SalI<br>(SEQ ID NO: 1079)<br>AAAGTCGACCAACATCTCCTCCAAAACATTC<br>BDL225_NR_XbaI<br>(SEQ ID NO: 1080)<br>ACTCTAGATTAGCAAGAAGAAAAGAAGTGCAG<br>BDL225_ER_XbaI<br>(SEQ ID NO: 1081)<br>ATTCTAGATTAGTAGTTTATACAAGGTGCGGAGAC |
| BDL226 | EcoRV, EcoRV | BDL226_NF_EcoRV<br>(SEQ ID NO: 1082)<br>AAGATATCGAAACTGGATCTGGGTTTATCC<br>BDL226_NR_EcoRV<br>(SEQ ID NO: 1083)<br>ATGATATCCTAAACTAATCAAACATGGCACATAC |
| BDL227 | | BDL227_NF_SalI<br>(SEQ ID NO: 1084)<br>AAAGTCGACAGAGTTAAGTCAATCACCAAACC<br>BDL227_NR_SmaI<br>(SEQ ID NO: 1085)<br>TCCCGGGTTACCATCAAGTTTTCTTGCTGAAG |
| BDL228 | SalI, XbaI | BDL228_NF_SalI<br>(SEQ ID NO: 1086)<br>AAAGTCGACCCAACACTATATCATGGCTACTATC<br>BDL228_NR_XbaI<br>(SEQ ID NO: 1087)<br>ATTCTAGACTAACCTCACTTGATGCTCTTGC |
| BDL229 | SalI, XbaI | BDL229_NR_XbaI<br>(SEQ ID NO: 1088)<br>TATCTAGAGCTAAACAAAATCCGGAGATAG<br>BDL229_ER_XbaI<br>(SEQ ID NO: 1089)<br>TATCTAGACAGTCACTCCATAACTATGATCAAAC<br>BDL229_F_SalI<br>(SEQ ID NO: 1090)<br>TTAGTCGACCTCATTAATGGAAGTTTCAACATC<br>BDL229_F_SalI<br>(SEQ ID NO: 1091)<br>TTAGTCGACCTCATTAATGGAAGTTTCAACATC |
| BDL230 | SmaI, SmaI | BDL230_NF_SmaI<br>(SEQ ID NO: 1092)<br>TCCCGGGTAAGTTTGTGAGATGGAATTAGTG<br>BDL230_NR_SmaI<br>(SEQ ID NO: 1093)<br>TCCCGGGCTAATTGGTTGGTTACAAGATGC |

TABLE 18-continued

The PCR primers used for cloning the genes of the invention

| Gene Name | Restriction Enzymes used for cloning | Primers used for amplification |
| --- | --- | --- |
| BDL231 | SalI, XbaI | BDL231_NF_SalI<br>(SEQ ID NO: 1094)<br>AATGTCGACTGGACTGAAGATGTCAGGATTC<br>BDL231_EF_SalI<br>(SEQ ID NO: 1095)<br>ATAGTCGACATTTCTCTCTATTGGCATCGAC<br>BDL231_NR_XbaI<br>(SEQ ID NO: 1096)<br>AATTCTAGACTAAACTGGGGAAAGCTAAAACG<br>BDL231_ER_XbaI<br>(SEQ ID NO: 1097)<br>AATTCTAGATCATAACATAAGAAAGTAAACTGGGG |
| BDL232 | XbaI, SacI | BDL232_NF_XbaI<br>(SEQ ID NO: 1098)<br>AATCTAGACACACCCCTCAAAGAAATATAAC<br>BDL232_EF_XbaI<br>(SEQ ID NO: 1099)<br>AATCTAGAAAGAAATTCACACCCCTCAAAG<br>BDL232_NR_SacI<br>(SEQ ID NO: 1100)<br>TGAGCTCCTAAAGGTGGAGTAATTAGAAGCG<br>BDL232_ER_SacI<br>(SEQ ID NO: 1101)<br>TGAGCTCTGGTGAAGTGTTAAGTAATTGTCG |
| BDL233 | SalI, SacI | BDL233_NF_SalI<br>(SEQ ID NO: 1102)<br>AAAGTCGACGAAAGAGAGAAAATGGAGAATATG<br>BDL233_EF_SalI<br>(SEQ ID NO: 1103)<br>AAAGTCGACCGATCTAAAGAAAGAGAGAAAATG<br>BDL233_NR_SacI<br>(SEQ ID NO: 1104)<br>TGAGCTCCTAAGAGTCGATCTAGAAAGCAACATC<br>BDL233_ER_SacI<br>(SEQ ID NO: 1105)<br>TGAGCTCGAATTAGTCCTTGTGGTTCTACTC |
| BD;234 | SalI, SmaI | BDL234_NF_SalI<br>(SEQ ID NO: 1106)<br>AATGTCGACTGATAAGAATGCTCCTGACTGG<br>BDL234_EF_SalI<br>(SEQ ID NO: 1107)<br>AATGTCGACTCTTTCTCTGTATCTCGACGTTC<br>BDL234_NR_SmaI<br>(SEQ ID NO: 1108)<br>TCCCGGGCTAAAATCCAAGTGCCCAAGAAC<br>BDL234_ER_SmaI<br>(SEQ ID NO: 1109)<br>TCCCGGGCTAGCAAAACATAAATCCAAGTGC |
| BDL235 | SalI, SmaI | BDL235_NF_SalI<br>(SEQ ID NO: 1110)<br>AATGTCGACTCTTACTCAATCCGAAGAATGG<br>BDL235_NR_SmaI<br>(SEQ ID NO: 1111)<br>CCCCGGGACTTCGATTCACATTTCTCCTC |
| BDL237 | SalI, XbaI | BDL237_NF_SalI<br>(SEQ ID NO: 1112)<br>AAAGTCGACCGAAGTAAGAAAAGAAAATGGAG<br>BDL237_EF_SalI<br>(SEQ ID NO: 1113)<br>AAAGTCGACCTTCGAAGTAAGAAAAGAAAATG<br>BDL237_NR_XbaI<br>(SEQ ID NO: 1114)<br>AATCTAGATCATACTCAAGTGCTTGTCCTCGG<br>BDL237_ER_XbaI<br>(SEQ ID NO: 1115)<br>ATTCTAGAGTTATTGGTGTCTTGTTCCACC |

TABLE 18-continued

The PCR primers used for cloning the genes of the invention

| Gene Name | Restriction Enzymes used for cloning | Primers used for amplification |
|---|---|---|
| BDL238 | SalI, XbaI | BDL238_NF_SalI<br>(SEQ ID NO: 1116)<br>AAAGTCGACCAACGAGCAAGAGAAAATGG<br>BDL238_EF_SalI<br>(SEQ ID NO: 1117)<br>AAAGTCGACGATACAACGAGCAAGAGAAAATG<br>BDL238_NR_XbaI<br>(SEQ ID NO: 1118)<br>AATTCTAGATGGTTCTAGCTATCACTAGGTGC<br>BDL238_ER_XbaI<br>(SEQ ID NO: 1119)<br>AATTCTAGAGGCAATACAACAAGAGAAAACTC |
| BDL240 | SalI, XbaI | BDL240_NF_SalI<br>(SEQ ID NO: 1120)<br>AAAGTCGACCGAGTACAATGGAGGTTTCG<br>BDL240_NR_XbaI<br>(SEQ ID NO: 1121)<br>ATTCTAGATCAAGCTTAAAGACCGTGAGGAAG |
| BDL241 | XbaI, SmaI | BDL241_NF_XbaI<br>(SEQ ID NO: 1122)<br>AATCTAGAACAGTCGTCGTCGTCAAGC<br>BDL241_NR_SmaI<br>(SEQ ID NO: 1123)<br>TCCCGGGCTAAAGGTAAGGATGAATTGTCAGAG |
| BDL242 | SalI, XbaI | BDL242_NF_SalI<br>(SEQ ID NO: 1124)<br>AATGTCGACTCAAATCAATATGGGATCTTTC<br>BDL242_NR_XbaI<br>(SEQ ID NO: 1125)<br>ATTCTAGATTATTGACAAGTCTATTGCCCG |
| BDL245 | SalI, SmaI | BDL245_NF_SalI<br>(SEQ ID NO: 1126)<br>AATGTCGACTTCGTTAAATTATGTCTTTGAGG<br>BDL245_EF_SalI<br>(SEQ ID NO: 1127)<br>AAAGTCGACTGACTCAGAGATCAACAAAACC<br>BDL245_NR_SmaI<br>(SEQ ID NO: 1128)<br>ACCCGGGTTAGACTTACTCCAATTTCCAAGC<br>BDL245_ER_SmaI<br>(SEQ ID NO: 1129)<br>TCCCGGGTCAAGAGTCGGTCACACGC |
| BDL247 | SmaI, SacI | BDL247_NF_SmaI<br>(SEQ ID NO: 1130)<br>TCCCGGGTCCTTCTTGTGTGAGACCGAG<br>BDL247_NR_SacI<br>(SEQ ID NO: 1131)<br>TGAGCTCCTAAGAACTTTAACGCATTTTGTAGTG |
| BDL248 | SalI, XbaI | BDL248_NF_SalI<br>(SEQ ID NO: 1132)<br>AAAGTCGACAACGTGATCAATATGGAAGCTC<br>BDL248_EF_SalI<br>(SEQ ID NO: 1133)<br>AAAGTCGACACTCACCAAAATCCAACGTG<br>BDL248_NR_XbaI<br>(SEQ ID NO: 1134)<br>AATTCTAGACTAAACTCAAGAGGAGTCGGGTAAG<br>BDL248_ER_XbaI<br>(SEQ ID NO: 1135)<br>AATTCTAGATTAATTCGTTACCGTTGCTAAG |

TABLE 18-continued

The PCR primers used for cloning the genes of the invention

| Gene Name | Restriction Enzymes used for cloning | Primers used for amplification |
|---|---|---|
| BDL249 | SalI, XbaI | BDL249_NF_SalI<br>(SEQ ID NO: 1136)<br>AAAGTCGACACCAAAATAGATCTAAAACATGG<br>BDL249_EF_SalI<br>(SEQ ID NO: 1137)<br>AATGTCGACTTCACTCACCAAAATAGATCTAAAAC<br>BDL249_NR_XbaI<br>(SEQ ID NO: 1138)<br>AATCTAGATCAACGTCAAACGGACTCGTTG<br>BDL249_ER_XbaI<br>(SEQ ID NO: 1139)<br>AATCTAGATCACCAAAAGTCTAAACGTCAAACG |
| BDL250 | SalI, XbaI | BDL250_NF_SalI<br>(SEQ ID NO: 1140)<br>TTAGTCGACCAAAGATGTTTTACTATGTGATTGTC<br>BDL250_EF_SalI<br>(SEQ ID NO: 1141)<br>TTAGTCGACAGGAAGAGAAAGGTCAAAGATG<br>BDL250_NR_XbaI<br>(SEQ ID NO: 1142)<br>TATCTAGATCAAAATCTCACATCTCCATGCATAG<br>BDL250_ER_XbaI<br>(SEQ ID NO: 1143)<br>TATCTAGATCATGTTCGCATTACACAAATATCC |
| BDL252 | XbaI, SmaI | BDL252_NF_XbaI<br>(SEQ ID NO: 1144)<br>ATTCTAGATTCTCTGTCTCTTTGGCTTTTC<br>BDL252_EF_XbaI<br>(SEQ ID NO: 1145)<br>ATTCTAGATAAAACTCTCAGCTTCCCATTC<br>BDL252_NR_SmaI<br>(SEQ ID NO: 1146)<br>TCCCGGGCTATTGTCATTGAGGAAGAACAGG<br>BDL252_ER_SmaI<br>(SEQ ID NO: 1147)<br>TCCCGGGCTAAAAGTTCTTGCTTGCTTTCTG |
| BDL48 | SalI, XbaI | BDL48_NF_SalI<br>(SEQ ID NO: 1148)<br>AAAGTCGACAGATTGCGTCACTGTAGTAGTAGTAG<br>BDL48_EF_SalI<br>(SEQ ID NO: 1149)<br>AAAGTCGACCTGCAACTCTTTCTCACTTTCAC<br>BDL48_NR_XbaI<br>(SEQ ID NO: 1150)<br>AGTCTAGAAAACATTTTGCTTAAGATCTACAGAG<br>BDL48_ER_XbaI<br>(SEQ ID NO: 1151)<br>ACTCTAGAAGACATGAAAGCACAAATCAAG |
| BDL49 | SmaI, SacI | BDL49_NF_SmaI<br>(SEQ ID NO: 1152)<br>ACCCGGGCTAACATGCTCCATCTCCTTC<br>BDL49_NR_SacI<br>(SEQ ID NO: 1153)<br>TGAGCTCTCAACCTGATCAGCGATGGTCG |
| BDL58 | SalI, XbaI | BDL58_NF_SalI<br>(SEQ ID NO: 1154)<br>AAAGTCGACCACACAAGACTAACGATGTTGC<br>BDL58_NR_XbaI<br>(SEQ ID NO: 1155)<br>ATTCTAGATTAAAAAGAGACCTACACGGCG |
| BDL62 | SalI, SacI | BDL62_NE_SalI<br>(SEQ ID NO: 1156)<br>AATGTCGACTCTCTGGTCTCCCTATATCAGC<br>BDL62_NR_SacI<br>(SEQ ID NO: 1157)<br>TGAGCTCCTATTTGATGTTGTTGTTGTTGTCTG |

TABLE 18-continued

The PCR primers used for cloning the genes of the invention

| Gene Name | Restriction Enzymes used for cloning | Primers used for amplification |
|---|---|---|
| BDL63 | SalI, XbaI | BDL63_NF_SalI<br>(SEQ ID NO: 1158)<br>ATAGTCGACGTTTTGAGATATGGGAGGACC<br>BDL63_EF_SalI<br>(SEQ ID NO: 1159)<br>AAAGTCGACCTCTAGATTCTTGGCGATTCTC<br>BDL63_NR_XbaI<br>(SEQ ID NO: 1160)<br>ATTCTAGATTAGTGGTTTTACTTGAGCCTCTCC<br>BDL63_ER_SacI<br>(SEQ ID NO: 1161)<br>TGAGCTCCTATTGTTCGTTACGGTGGTTTTAC |
| BDL64 | | BDL64_NF_SalI<br>(SEQ ID NO: 1162)<br>AATGTCGACGGACTTTAAACATGGGTGTTC<br>BDL64_NR_XbaI<br>(SEQ ID NO: 1163)<br>ATTCTAGACTACTCATAGGTTTGTTACTTCCTTG |
| BDL75 | SalI, XbaI | BDL75_NF_SalI<br>(SEQ ID NO: 1164)<br>AAAGTCGACAAGAAGAAAGAAACAGAGAATCG<br>BDL75_NR_XbaI<br>(SEQ ID NO: 1165)<br>ATTCTAGACTAATTGTTCAAAGTTCAGTGAGCC |
| BDL79 | XbaI, SmaI | BDL79_NF_XbaI<br>(SEQ ID NO: 1166)<br>ATTCTAGAGGAGATTTTGTAATGGATTCTGC<br>BDL79_EF_XbaI<br>(SEQ ID NO: 1167)<br>ATTCTAGAGAAGGAGATTTTGTAATGGATTC<br>BDL79_NR_Sma<br>(SEQ ID NO: 1168)<br>TCCCGGGTTACGCTTAGACCATACAACGAGTAG<br>BDL79_ER_Sma<br>(SEQ ID NO: 1169)<br>TCCCGGGGTTATTTACTTATGGCCTGTTTC |
| BDL81 | SalI, SacI | BDL81_EF_SalI<br>(SEQ ID NO: 1170)<br>AAAGTCGACCAGGGGTTTAAGGATTTTCTC<br>BDL81_ER_SacI<br>(SEQ ID NO: 1171)<br>CGAGCTCAAATGGCTTTCTCTACCCTTTG |
| BDL83 | SalI, XbaI | BDL83_NF_SalI<br>(SEQ ID NO: 1172)<br>AATGTCGACTGGTAGGCTGAGAGAAAGAAAG<br>BDL83_NR_XbaI<br>(SEQ ID NO: 1173)<br>AGTCTAGATTAGAGAATAAAAGAAGAATGAGAAGC |
| BDL85 | XbaI, SalI | BDL85_NF_SalI<br>(SEQ ID NO: 1174)<br>AATGTCGACTTAATCGTTAGAAGATGAGCCAG<br>BDL85_NR_XbaI<br>(SEQ ID NO: 1175)<br>ATTCTAGATCAGGCTTAGAAGCAAATGTCCAG |
| BDL88 | SalI, XbaI | BDL88_NF_SalI<br>(SEQ ID NO: 1176)<br>AATGTCGACGAGGAGATGGCGAGCAAC<br>BDL88_NR_XbaI<br>(SEQ ID NO: 1177)<br>TATCTAGATTATTAGGTATTGCACTTCCACTTC |
| BDL90 | | BDL90_EF_SalI<br>(SEQ ID NO: 1178)<br>BDL90 AAAGTCGACCACCAGAAACAAAGAGAGAGTG<br>BDL90_ER_XbaI<br>(SEQ ID NO: 1179)<br>ATTCTAGATATCATGCAACCACAAACAATAG |

TABLE 18-continued

The PCR primers used for cloning the genes of the invention

| Gene Name | Restriction Enzymes used for cloning | Primers used for amplification |
|---|---|---|
| BDL94 | XbaI, SmaI | BDL94_EF_XbaI_new (SEQ ID NO: 1180) AATCTAGAAAGTCCAAGTGACCAACCATC BDL94_ER_SmaI_new (SEQ ID NO: 1181) TCCCGGGGGGATACAAGATTATGCAGGC |

Table 18. Provided are the PCR primers used for cloning the genes of some embodiments of the invention. Fwd = forward primer; Rev = reverse primer; Nested = nested primer for PCR (internal primer); External = external primer for PCR.

To facilitate cloning of the cDNAs/genomic sequences, a 8-12 by extension was added to the 5' of each primer. The primer extension includes an endonuclease restriction site. The restriction sites were selected using two parameters: (a). The site did not exist in the cDNA sequence; and (b). The restriction sites in the forward and reverse primers were designed such that the digested cDNA is inserted in the sense formation into the binary vector utilized for transformation.

Each digested PCR product was inserted into a high copy vector pBlue-script KS plasmid vector [pBlue-script KS plasmid vector, Hypertext Transfer Protocol://World Wide Web (dot) stratagene (dot) com/manuals/212205 (dot) pdf] or into plasmids originating from this vector. In cases where the pGXN high copy vector (originated from pBlue-script KS) was used, the PCR product was inserted upstream to the NOS terminator (SEQ ID NO:1182) originated from pBI 101.3 binary vector (GenBank Accession No. U12640, nucleotides 4356 to 4693) and downstream to the 35S promoter (Table 20 below). The digested products and the linearized plasmid vector were ligated using T4 DNA ligase enzyme (Roche, Switzerland).

Sequencing of the amplified PCR products was performed, using ABI 377 sequencer (Amersham Biosciences Inc). In all cases, after confirmation of the sequence of the cloned genes, the cloned cDNA accompanied or not with the NOS terminator was introduced into the pGI binary vector [pBXYN or pQXYN containing the 35S CaMV promoter] according to Table 19 hereinabove, via digestion with appropriate restriction endonucleases. In any case the insert was followed by single copy of the NOS terminator (SEQ ID NO:1182x).

High copy plasmids containing the cloned genes were digested with the restriction endonucleases (New England BioLabs Inc) according to the sites designed in the primers (Table 18, above) and cloned into binary vectors according to Table 19, below.

Binary vectors used for cloning: The plasmid pPI was constructed by inserting a synthetic poly-(A) signal sequence, originating from pGL3 basic plasmid vector (Promega, Acc No U47295; by 4658-4811) into the HindIII restriction site of the binary vector pBI101.3 (Clontech, Acc. No. U12640). pGI (pBXYN) (FIG. 1) is similar to pPI, but the original gene in the backbone, the GUS gene, was replaced by the GUS-Intron gene followed by the NOS terminator (SEQ ID NO:1182) (Vancanneyt. G, et al MGG 220, 245-50, 1990). pGI was used to clone the polynucleotide sequences, initially under the control of 35S promoter [Odell, J T, et al. Nature 313, 810-812 (28 Feb. 1985); SEQ ID NO:1184.

The modified pGI vector (pQXYN) is a modified version of the pGI vector in which the cassette is inverted between the left and right borders so the gene and its corresponding promoter are close to the right border and the NPTII gene is close to the left border.

TABLE 19

Restriction enzyme sites used to clone the identified genes into binary vector

| Gene name | Binary vector | Restriction enzymes used for cloning into binary vector-FORWARD | Restriction enzymes used for cloning into binary vector-REVERSE | Restriction enzymes used for digesting the binary vector |
|---|---|---|---|---|
| BDL62 | pQXYN | SalI | SacI | SalI, SacI |
| BDL75 | pQXYN | SalI | EcoRI | SalI, EcoRI |
| BDL79 | pQXYN | XbaI | SmaI | XbaI, Ecl136II |
| BDL81 | pQXYN | SalI | SacI | SalI, SacI |
| BDL83 | pQXYN | SalI | EcoRI | SalI, EcoRI |
| BDL117 | pQXYN | SmaI | SmaI | SmaI, Ecl136II |
| BDL118 | pQXYN | SmaI | SmaI | SmaI, Ecl136II |
| BDL138 | pQXYN | SalI | EcoRI | SalI, EcoRI |
| BDL140 | pQXYN | XbaI | SacI | XbaI, SacI |
| BDL147 | pQXYN | SalI | EcoRI | SalI, EcoRI |
| BDL149 | pQXYN | SalI | EcoRI | SalI, EcoRI |
| BDL152 | pQXYN | XbaI | SacI | XbaI, SacI |
| BDL153 | pQXYN | SalI | SmaI | SalI, Ecl136II |
| BDL154 | pQXYN | SalI | SacI | SalI, SacI |
| BDL155 | pQXYN | SalI | EcoRI | SalI, EcoRI |
| BDL156 | pQXYN | SalI | SacI | SacI, SalI |
| BDL157 | pQXYN | SalI | SacI | SalI, SacI |
| BDL158 | pQXYN | XbaI | SmaI | XbaI, Ecl136II |
| BDL160 | pQXYN | SalI | EcoRI | SalI, EcoRI |
| BDL162 | pQXYN | SalI | EcoRI | SalI, EcoRI |
| BDL167 | pQXYN | SalI | EcoRI | SalI, EcoRI |
| BDL168 | pQXYN | XbaI | SmaI | XbaI, Ecl136II |
| BDL169 | pQXYN | SalI | EcoRI | SalI, EcoRI |
| BDL171 | pQXYN | XbaI | SacI | XbaI, SacI |
| BDL173 | pQXYN | XbaI | SmaI | XbaI, Ecl136II |
| BDL174 | pQXYN | SalI | SacI | SalI, SacI |
| BDL176 | pQXYN | SmaI | SmaI | SmaI, Ecl136II |
| BDL177 | pQXYN | SalI | SacI | SalI, SacI |
| BDL181 | pQXYN | SalI | SacI | SalI, SacI |
| BDL182 | pQXYN | SalI | SacI | SalI, SacI |
| BDL183 | pQXYN | SalI | EcoRI | SalI, EcoRI |
| BDL186 | pQXYN | SalI | SacI | SalI, SacI |
| BDL187 | pQXYN | SalI | SmaI | SalI, Ecl136II |
| BDL188 | pQXYN | XbaI | SmaI | XbaI, Ecl136II |
| BDL189 | pQXYN | SmaI | BamHI | SmaI, Ecl136II |
| BDL190 | pQXYN | SalI | EcoRI | SalI, EcoRI |
| BDL192 | pQXYN | SalI | EcoRI | SalI, EcoRI |
| BDL193 | pQXYN | XbaI | SacI | XbaI, SacI |
| BDL194 | pQXYN | EcoRV | EcoRV | SmaI, Ecl136II |
| BDL196 | pQXYN | SalI | EcoRI | SalI, EcoRI |
| BDL197 | pQXYN | SalI | EcoRI | SalI, EcoRI |
| BDL201 | pQXYN | SalI | EcoRI | SalI, EcoRI |
| BDL203 | pQXYN | SalI | EcoRI | SalI, EcoRI |
| BDL220 | pQXYN | SalI | EcoRI | SalI, EcoRI |
| BDL221 | pQXYN | SalI | EcoRI | SalI, EcoRI |
| BDL222 | pQXYN | SalI | EcoRI | SalI, EcoRI |

TABLE 19-continued

Restriction enzyme sites used to clone the identified genes into binary vector

| Gene name | Binary vector | Restriction enzymes used for cloning into binary vector-FORWARD | Restriction enzymes used for cloning into binary vector-REVERSE | Restriction enzymes used for digesting the binary vector |
|---|---|---|---|---|
| BDL223 | pQXYN | SalI | EcoRI | SalI, EcoRI |
| BDL229 | pQXYN | SalI | EcoRI | SalI, EcoRI |
| BDL230 | pQXYN | SmaI | SmaI | SmaI, Ecl136II |
| BDL231 | pQXYN | SalI | EcoRI | SalI, EcoRI |
| BDL235 | pQXYN | SalI | SmaI | SalI, Ecl136II |
| BDL242 | pQXYN | SalI | EcoRI | SalI, EcoRI |
| BDL245 | pQXYN | SalI | SmaI | SalI, Ecl136II |
| BDL247 | pQXYN | SmaI | SacI | SmaI, SacI |
| BDL248 | pQXYN | SalI | EcoRI | SalI, EcoRI |
| BDL250 | pQXYN | SalI | EcoRI | SalI, EcoRI |
| BDL49 | pQXYN | EcoRV | SacI | SmaI, SacI |
| BDL58 | pQXYN | SalI | EcoRI | SalI, EcoRI |
| BDL63 | pQXYN | SalI | SacI | SalI, SacI |
| BDL64 | pQXYN | SalI | XbaI | SalI, Ecl136II |
| BDL85 | pQXYN | SalI | EcoRI | SalI, EcoRI |
| BDL88 | pQXYN | SalI | EcoRI | SalI, EcoRI |
| BDL90 | pQXYN | XbaI | SalI | SalI, Ecl136II |
| BDL94 | pQXYN | XbaI | SmaI | xbaI, Ecl136II |
| BDL102 | pQXYN | SalI | EcoRI | SalI, EcoRI |
| BDL224 | pQXYN | XbaI | EcoRI | XbaI, EcoRI |
| BDL225 | pQXYN | SalI | EcoRI | SalI, EcoRI |
| BDL226 | pQXYN | EcoRV | EcoRV | SmaI, Ecl136II |
| BDL227 | pQXYN | SalI | SmaI | SalI, Ecl136II |
| BDL228 | pQXYN | SalI | EcoRI | SalI, EcoRI |
| BDL232 | pQXYN | XbaI | EcoRI | XbaI, EcoRI |
| BDL233 | pQXYN | SalI | EcoRI | SalI, EcoRI |
| BDL234 | pQXYN | SalI | SmaI | SalI, Ecl136II |
| BDL237 | pQXYN | SalI | SacI | SalI, SacI |
| BDL238 | pQXYN | SalI | EcoRI | SalI, EcoRI |
| BDL240 | pQXYN | SalI | SacI | SalI, SacI |
| BDL241 | pQXYN | XbaI | SmaI | XbaI, Ecl136II |
| BDL249 | pQXYN | SalI | EcoRI | SalI, EcoRI |
| BDL252 | pQXYN | XbaI | SmaI | XbaI, Ecl136II |
| BDL47 | pQXYN | XbaI | SmaI | XbaI, Ecl136II |
| BDL48 | pQXYN | SalI | EcoRI | SalI, EcoRI |

Table 19.

TABLE 20

Genes cloned from cDNA libraries or genomic DNA in a High copy number plasmid

| Gene Name | High copy plasmid | Amplified from Organism | Origin | Polynucleotide SEQ ID NO: | Polypeptide SEQ ID NO: |
|---|---|---|---|---|---|
| BDL62 | pGXN (pKG + Nos + 35S) | Arabidopsis thaliana | RNA ND | 847 | 108 |
| BDL75 | pGXN (pKG + Nos + 35S) | Arabidopsis thaliana | RNA ND | 848 | 109 |
| BDL79 | pKS(Pks_J) | Arabidopsis thaliana | RNA ND | 849 | 110 |
| BDL81 | pGXN (pKG + Nos + 35S) | Arabidopsis thaliana | RNA ND | 850 | 111 |
| BDL83 | pGXN (pKG + Nos + 35S) | Arabidopsis thaliana | RNA ND | 851 | 112 |
| BDL117 | Topo B | Arabidopsis thaliana | RNA ND | 852 | 926 |
| BDL118 | Topo B | Arabidopsis thaliana | RNA ND | 853 | 114 |
| BDL138 | pGXN (pKG + Nos + 35S) | Arabidopsis thaliana | RNA ND | 854 | 116 |
| BDL140 | pGXN (pKG + Nos + 35S) | Arabidopsis thaliana | RNA ND | 855 | 117 |
| BDL147 | pGXN (pKG + Nos + 35S) | Arabidopsis thaliana | RNA ND | 856 | 118 |
| BDL149 | pGXN (pKG + Nos + 35S) | Arabidopsis thaliana | RNA ND | 857 | 119 |
| BDL152 | pGXN (pKG + Nos + 35S) | Arabidopsis thaliana | RNA ND | 858 | 120 |
| BDL153 | pKS(Pks_J) | Arabidopsis thaliana | RNA ND | 859 | 121 |
| BDL154 | pGXN (pKG + Nos + 35S) | Arabidopsis thaliana | RNA ND | 860 | 122 |
| BDL155 | pGXN (pKG + Nos + 35S) | Arabidopsis thaliana | RNA ND | 861 | 123 |
| BDL156 | pGXN (pKG + Nos + 35S) | Arabidopsis thaliana | RNA ND | 862 | 124 |
| BDL157 | pGXN (pKG + Nos + 35S) | Arabidopsis thaliana | RNA ND | 863 | 125 |
| BDL158 | pKS(Pks_J) | Arabidopsis thaliana | RNA ND | 864 | 126 |
| BDL160 | pGXN (pKG + Nos + 35S) | Arabidopsis thaliana | RNA ND | 865 | 127 |

TABLE 20-continued

Genes cloned from cDNA libraries or genomic DNA in a High copy number plasmid

| Gene Name | High copy plasmid | Amplified from Organism | Origin | Polynucleotide SEQ ID NO: | Polypeptide SEQ ID NO: |
|---|---|---|---|---|---|
| BDL162 | pGXN (pKG + Nos + 35S) | *Arabidopsis thaliana* ND | RNA | 866 | 128 |
| BDL167 | pGXN (pKG + Nos + 35S) | *Arabidopsis thaliana* ND | RNA | 867 | 196 |
| BDL168 | pKS(Pks_J) | *Arabidopsis thaliana* ND | RNA | 868 | 132 |
| BDL169 | pGXN (pKG + Nos + 35S) | *Arabidopsis thaliana* ND | RNA | 869 | 133 |
| BDL171 | pGXN (pKG + Nos + 35S) | *Arabidopsis thaliana* ND | RNA | 870 | 927 |
| BDL173 | pKS(Pks_J) | *Arabidopsis thaliana* ND | RNA | 871 | 135 |
| BDL174 | pGXN (pKG + Nos + 35S) | *Arabidopsis thaliana* ND | RNA | 872 | 136 |
| BDL176 | pKS(Pks_J) | *Arabidopsis thaliana* ND | RNA | 873 | 137 |
| BDL177 | pGXN (pKG + Nos + 35S) | *Arabidopsis thaliana* ND | RNA | 874 | 138 |
| BDL181 | pGXN (pKG + Nos + 35S) | *Arabidopsis thaliana* ND | RNA | 875 | 139 |
| BDL182 | pGXN (pKG + Nos + 35S) | *Arabidopsis thaliana* ND | RNA | 876 | 140 |
| BDL183 | pGXN (pKG + Nos + 35S) | *Arabidopsis thaliana* ND | RNA | 877 | 141 |
| BDL186 | pGXN (pKG + Nos + 35S) | *Arabidopsis thaliana* ND | RNA | 878 | 928 |
| BDL187 | pKS(Pks_J) | *Arabidopsis thaliana* ND | RNA | 879 | 929 |
| BDL188 | pKS(Pks_J) | *Arabidopsis thaliana* ND | RNA | 880 | 144 |
| BDL189 | Topo B | *Arabidopsis thaliana* ND | RNA | 881 | 145 |
| BDL190 | pGXN (pKG + Nos + 35S) | *Arabidopsis thaliana* ND | RNA | 882 | 146 |
| BDL192 | pGXN (pKG + Nos + 35S) | *Arabidopsis thaliana* ND | RNA | 883 | 147 |
| BDL193 | pGXN (pKG + Nos + 35S) | *Arabidopsis thaliana* ND | RNA | 884 | 148 |
| BDL194 | pKS(Pks_J) | *Arabidopsis thaliana* ND | RNA | 885 | 149 |
| BDL196 | pGXN (pKG + Nos + 35S) | *Arabidopsis thaliana* ND | RNA | 886 | 150 |
| BDL197 | pGXN (pKG + Nos + 35S) | *Arabidopsis thaliana* ND | RNA | 887 | 151 |
| BDL201 | pGXN (pKG + Nos + 35S) | *Arabidopsis thaliana* ND | RNA | 888 | 153 |
| BDL203 | pGXN (pKG + Nos + 35S) | *Arabidopsis thaliana* ND | RNA | 889 | 154 |
| BDL220 | pGXN (pKG + Nos + 35S) | *Arabidopsis thaliana* ND | RNA | 890 | 156 |
| BDL221 | pGXN (pKG + Nos + 35S) | *Arabidopsis thaliana* ND | RNA | 891 | 157 |
| BDL222 | pGXN (pKG + Nos + 35S) | *Arabidopsis thaliana* ND | RNA | 892 | 158 |
| BDL223 | pGXN (pKG + Nos + 35S) | *Arabidopsis thaliana* ND | RNA | 893 | 159 |
| BDL229 | pGXN (pKG + Nos + 35S) | *Arabidopsis thaliana* ND | RNA | 894 | 160 |
| BDL230 | pKS(Pks_J) | *Arabidopsis thaliana* ND | RNA | 895 | 161 |
| BDL231 | pGXN (pKG + Nos + 35S) | *Arabidopsis thaliana* ND | RNA | 896 | 162 |
| BDL235 | pKS(Pks_J) | *Arabidopsis thaliana* ND | RNA | 897 | 163 |
| BDL242 | pGXN (pKG + Nos + 35S) | *Arabidopsis thaliana* ND | RNA | 898 | 164 |
| BDL245 | pKS(Pks_J) | *Arabidopsis thaliana* ND | RNA | 899 | 166 |

TABLE 20-continued

Genes cloned from cDNA libraries or genomic DNA in a High copy number plasmid

| Gene Name | High copy plasmid | Amplified from Organism | Origin | Polynucleotide SEQ ID NO: | Polypeptide SEQ ID NO: |
|---|---|---|---|---|---|
| BDL247 | pKS(Pks_J) | Arabidopsis thaliana ND | RNA | 900 | 167 |
| BDL248 | pGXN (pKG + Nos + 35S) | Arabidopsis thaliana ND | RNA | 901 | 168 |
| BDL250 | pGXN (pKG + Nos + 35S) | Arabidopsis thaliana ND | RNA | 902 | 169 |
| BDL49 | pKS(Pks_J) | Arabidopsis thaliana ND | RNA | 903 | 170 |
| BDL58 | pGXN (pKG + Nos + 35S) | Arabidopsis thaliana ND | RNA | 904 | 171 |
| BDL63 | pGXN (pKG + Nos + 35S) | Arabidopsis thaliana ND | RNA | 905 | 172 |
| BDL64 | Topo B | Arabidopsis thaliana ND | RNA | 906 | 173 |
| BDL85 | pGXN (pKG + Nos + 35S) | Arabidopsis thaliana ND | RNA | 907 | 175 |
| BDL88 | pGXN (pKG + Nos + 35S) | RICE Oryza sativa L. Japonica ND | RNA | 908 | 176 |
| BDL90 | Topo B | RICE Oryza sativa L. Japonica ND | gDNA | 909 | Non Coding polynucleotide |
| BDL94 | pGXN (pKG + Nos + 35S) | Rice Japonica ND leaves | gDNA | 910 | 930 |
| BDL102 | pGXN (pKG + Nos + 35S) | MAIZE Zea mays L. ND | RNA | 911 | 178 |
| BDL224 | pGXN (pKG + Nos + 35S) | Arabidopsis thaliana ND | RNA | 912 | 179 |
| BDL225 | pGXN (pKG + Nos + 35S) | Arabidopsis thaliana ND | RNA | 913 | 180 |
| BDL226 | pKS(Pks_J) | Arabidopsis thaliana ND | RNA | 914 | 181 |
| BDL227 | Topo B | Arabidopsis thaliana ND | RNA | 915 | 182 |
| BDL228 | pGXN (pKG + Nos + 35S) | CASTOR BEAN Ricinus communis L. ND | RNA | 916 | 931 |
| BDL232 | pGXN (pKG + Nos + 35S) | Arabidopsis thaliana ND | RNA | 917 | 184 |
| BDL233 | pGXN (pKG + Nos + 35S) | Arabidopsis thaliana ND | RNA | 918 | 932 |
| BDL234 | pKS(Pks_J) | Arabidopsis thaliana ND | RNA | 919 | 186 |
| BDL237 | pGXN (pKG + Nos + 35S) | Arabidopsis thaliana ND | RNA | 920 | 187 |
| BDL238 | pGXN (pKG + Nos + 35S) | Arabidopsis thaliana ND | RNA | 921 | 188 |
| BDL240 | pGXN (pKG + Nos + 35S) | Arabidopsis thaliana ND | RNA | 922 | 189 |
| BDL241 | pKS(Pks_J) | Arabidopsis thaliana ND | RNA | 923 | 190 |
| BDL249 | pGXN (pKG + Nos + 35S) | Arabidopsis thaliana ND | RNA | 924 | 191 |
| BDL252 | pKS(Pks_J) | Arabidopsis thaliana ND | RNA | 925 | 193 |
| BDL47 | High copy plasmid pMA | Synthetic DNA | | 845 | 106 |
| BDL48 | pGXN (pKG + Nos + 35S) | Arabidopsis thaliana ND | RNA | 846 | 107 |
| BDL200 | High copy plasmid | Synthetic DNA | | 47 | 152 |

Table 20: Cloned and synthetic genes are provided along with the sequence identifiers of their polynucleotides and polypeptides. Also provided are the source organism, tissue and the cloning vectors.
ND = not a determined ecotype.

Selected DNA sequences were synthesized by a commercial supplier GeneArt, GmbH [Hypertext Transfer Protocol://World Wide Web (dot) geneart (dot) com/)]. Synthetic DNA is designed in silico. Suitable restriction enzymes sites were added to the cloned sequences at the 5' end and at the 3' end to enabled later cloning into the pBXYN/pQXYN binary downstream of the CaMV 35S promoter (SEQ ID NO:1184). For example BDL47 (SEQ ID NO:1 was synthesized and the XbaI and SmaI restriction enzymes were added to the synthetic sequence in order to facilitate cloning.

For 7 genes, namely BDL117, BDL171, BDL186, BDL187, BDL94, BDL228 and BDL233, the protein translation of the amplified cDNA sequence did not match the initial bioinformatics prediction of the protein sequences. The polypeptide sequences encoded by the cloned sequence were predicted and are provided in SEQ ID NO: 926-932.

Example 8

Producing Transgenic Arabidopsis Plants Expressing the Identified Polynucleotides of the Invention Materials And Experimental Methods Plant transformation—The *Arabidopsis thaliana* var Columbia ($T_0$ plants) were transformed according to the Floral Dip procedure [Clough S J, Bent A F. (1998) Floral dip: a simplified method for *Agrobacterium*-mediated transformation of *Arabidopsis thaliana*. Plant J. 16(6): 735-43; and Desfeux C, Clough S J, Bent A F. (2000) Female reproductive tissues are the primary targets of *Agrobacterium*-mediated transformation by the *Arabidopsis* floral-dip method. Plant Physiol. 123(3): 895-904] with minor modifications. Briefly, *Arabidopsis thaliana* Columbia (Col0) $T_0$ plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hours light/dark cycles. The $T_0$ plants were ready for transformation six days before anthesis.

Single colonies of *Agrobacterium* carrying the binary vectors harboring the seed oil genes were cultured in LB medium supplemented with kanamycin (50 mg/L) and gentamycin (50 mg/L). The cultures were incubated at 28° C. for 48 hours under vigorous shaking and centrifuged at 4000 rpm for 5 minutes. The pellets comprising *Agrobacterium* cells were resuspended in a transformation medium which contained half-strength (2.15 g/L) Murashige-Skoog (Duchefa); 0.044 µM benzylamino purine (Sigma); 112 µg/L B5 Gambourg vitamins (Sigma); 5% sucrose; and 0.2 ml/L Silwet L-77 (OSI Specialists, CT) in double-distilled water, at pH of 5.7.

Transformation of $T_0$ plants was performed by inverting each plant into an *Agrobacterium* suspension such that the above ground plant tissue was submerged for 3-5 seconds. Each inoculated To plant was immediately placed in a plastic tray, then covered with clear plastic dome to maintain humidity and was kept in the dark at room temperature for 18 hours to facilitate infection and transformation. Transformed (transgenic) plants were then uncovered and transferred to a greenhouse for recovery and maturation. The transgenic $T_0$ plants were grown in the greenhouse for 3-5 weeks until siliques were brown and dry, then seeds were harvested from plants and kept at room temperature until sowing.

For generating $T_1$ and $T_2$ transgenic plants harboring the genes, seeds collected from transgenic $T_0$ plants were surface-sterilized by soaking in 70% ethanol for 1 minute, followed by soaking in 5% sodium hypochlorite and 0.05% triton for 5 minutes. The surface-sterilized seeds were thoroughly washed in sterile distilled water then placed on culture plates containing half-strength Murashig-Skoog (Duchefa); 2% sucrose; 0.8% plant agar; 50 mM kanamycin; and 200 mM carbenicylin (Duchefa). The culture plates were incubated at 4° C. for 48 hours then transferred to a growth room at 25° C. for an additional week of incubation. Vital $T_1$ *Arabidopsis* plants were transferred to a fresh culture plates for another week of incubation. Following incubation the $T_1$ plants were removed from culture plates and planted in growth mix contained in 250 ml pots. The transgenic plants were allowed to grow in a greenhouse to maturity. Seeds harvested from $T_1$ plants were cultured and grown to maturity as $T_2$ plants under the same conditions as used for culturing and growing the $T_1$ plants.

Example 9

Improved Transgenic Plant Performance

To analyze the effect of expression of the isolated polynucleotides in plants, plants were grown in pots with an adequate amount of nutrients and water. The plants were analyzed for their overall size, growth rate, time to inflorescence emergence (bolting) and flowering, seed yield, weight of 1,000 seeds, dry matter and harvest index [(HI) seed yield/dry matter]. Transgenic plants performance was compared to control plants grown in parallel under the same conditions. Mock-transgenic plants with an empty vector or expressing the uidA reporter gene (GUS-Intron) under the same promoter were used as control.

Parameters were measured as described in Examples 2, 3 and 4 above.

Statistical analyses—Plant growth rate, plant area, time to bolt, time to flower, weight of 1,000 seeds, seed yield, oil yield, dry matter, and harvest index area data were analyzed using t-test. To identify outperforming genes and constructs, results from mix of transformation events or independent events were analyzed. For gene versus control analysis t-test was applied, using significance of p<0.1. The JMP statistics software package was used (Version 5.2.1, SAS Institute Inc., Cary, N.C., USA).

Experimental Results

Plants expressing the polynucleotides of the invention were assayed for a number of commercially desired traits. Results are presented in Tables 21 and 22.

Analysis of plants in tissue culture assay—Tables 21 and 22, hereinbelow, depict analyses of seed yield in plants overexpressing the polynucleotides of the invention under the regulation of the constitutive 35S (SEQ ID NO:1184) or At6669 (SEQ ID NO:1183) promoters. In cases where a certain event appears more than once, the event was tested in several independent experiments.

TABLE 21

Results obtained in a tissue culture assay

| Gene | Ev. | Par. | Leaf Area TP1 | Leaf Area TP2 | Leaf Area TP3 | Roots Length TP1 | Roots Length TP2 | Roots Length TP3 | Roots Coverage TP1 |
|---|---|---|---|---|---|---|---|---|---|
| BDL102 | 10471.1 | P |  | 0.24 |  | 0.01 | 0.02 | 0.13 | 0.05 |
| BDL102 | 10471.1 | Av |  | 1.15 |  | 1.59 | 1.39 | 1.23 | 2.34 |
| BDL102 | 10471.3 | P |  | 0.6 |  | 0.03 | 0.01 | 0.09 | 0.01 |
| BDL102 | 10471.3 | Av |  | 1.1 |  | 1.43 | 1.37 | 1.24 | 1.72 |
| BDL102 | 10472.1 | P |  |  |  | 0.04 | 0.15 |  | 0.03 |
| BDL102 | 10472.1 | Av |  |  |  | 1.27 | 1.1 |  | 1.54 |
| BDL102 | 10474.2 | P | <0.01 | <0.01 | <0.01 |  | 0.23 | 0.13 |  |
| BDL102 | 10474.2 | Av | 2.02 | 1.61 | 1.51 |  | 1.1 | 1.13 |  |
| BDL102 | 10474.6 | P |  | 0.13 | 0.29 |  |  |  |  |
| BDL102 | 10474.6 | Av |  | 1.21 | 1.14 |  |  |  |  |

TABLE 21-continued

Results obtained in a tissue culture assay

| Gene | Ev. | Par. | Leaf Area TP1 | Leaf Area TP2 | Leaf Area TP3 | Roots Length TP1 | Roots Length TP2 | Roots Length TP3 | Roots Coverage TP1 |
|---|---|---|---|---|---|---|---|---|---|
| BDL118 | 10481.2 | P | <0.01 | 0.01 | 0.01 | | | 0.46 | |
| BDL118 | 10481.2 | Av | 2.02 | 1.91 | 2 | | | 1.1 | |
| BDL118 | 10481.5 | P | | 0.2 | 0.01 | | | | |
| BDL118 | 10481.5 | Av | | 1.15 | 1.29 | | | | |
| BDL118 | 10484.3 | P | <0.01 | <0.01 | <0.01 | | | | |
| BDL118 | 10484.3 | Av | 1.51 | 1.41 | 1.58 | | | | |
| BDL140 | 10421.3 | P | 0.03 | 0.01 | 0.05 | | | | 0.39 |
| BDL140 | 10421.3 | Av | 1.61 | 1.72 | 1.68 | | | | 1.18 |
| BDL140 | 10423.1 | P | 0.21 | 0.09 | 0.28 | 0.01 | 0.11 | | 0.19 |
| BDL140 | 10423.1 | Av | 1.24 | 1.31 | 1.21 | 1.38 | 1.21 | | 1.28 |
| BDL140 | 10424.4 | P | <0.01 | <0.01 | 0.01 | | | | |
| BDL140 | 10424.4 | Av | 1.43 | 1.48 | 1.62 | | | | |
| BDL152 | 10431.4 | P | 0.15 | 0.12 | 0.12 | | | | |
| BDL152 | 10431.4 | Av | 1.17 | 1.18 | 1.18 | | | | |
| BDL152 | 10432.5 | P | 0.37 | 0.01 | | 0.07 | 0.14 | | 0.35 |
| BDL152 | 10432.5 | Av | 1.16 | 1.28 | | 1.22 | 1.13 | | 1.25 |
| BDL152 | 10434.1 | P | | 0.43 | | | | | |
| BDL152 | 10434.1 | Av | | 1.12 | | | | | |
| BDL152 | 10434.4 | P | | 0.08 | | 0.04 | 0.01 | <0.01 | 0.08 |
| BDL152 | 10434.4 | Av | | 1.18 | | 1.52 | 1.48 | 1.31 | 2.33 |
| BDL153 | 10142.2 | P | | | | <0.01 | <0.01 | | 0.03 |
| BDL153 | 10142.2 | Av | | | | 1.83 | 1.43 | | 1.99 |
| BDL153 | 10144.1 | P | <0.01 | 0.02 | 0.07 | | 0.31 | 0.15 | 0.7 |
| BDL153 | 10144.1 | Av | 1.3 | 1.31 | 1.38 | | 1.13 | 1.12 | 1.1 |
| BDL153 | 10144.4 | P | | | | | | | 0.03 |
| BDL153 | 10144.4 | Av | | | | | | | 1.28 |
| BDL154 | 10703.1 | P | | | | 0.09 | 0.14 | 0.05 | 0.09 |
| BDL154 | 10703.1 | Av | | | | 1.36 | 1.14 | 1.2 | 1.77 |
| BDL154 | 10703.11 | P | | | | 0.01 | 0.17 | 0.3 | 0.5 |
| BDL154 | 10703.11 | Av | | | | 1.37 | 1.21 | 1.16 | 1.18 |
| BDL154 | 10703.6 | P | | | | | | | 0.42 |
| BDL154 | 10703.6 | Av | | | | | | | 1.23 |
| BDL154 | 10703.1 | P | <0.01 | <0.01 | <0.01 | | 0.11 | 0.02 | |
| BDL154 | 10703.1 | Av | 1.34 | 1.5 | 1.61 | | 1.14 | 1.18 | |
| BDL154 | 10703.5 | P | | 0.46 | 0.36 | | 0.02 | 0.02 | 0.21 |
| BDL154 | 10703.5 | Av | | 1.1 | 1.16 | | 1.47 | 1.39 | 1.52 |
| BDL154 | 10703.6 | P | | | | 0.24 | 0.06 | 0.07 | 0.15 |
| BDL154 | 10703.6 | Av | | | | 1.19 | 1.33 | 1.24 | 1.59 |
| BDL155 | 9994.3 | P | 0.22 | | | | | | |
| BDL155 | 9994.3 | Av | 1.15 | | | | | | |
| BDL156 | 10853.6 | P | | | 0.08 | | | | |
| BDL156 | 10853.6 | Av | | | 1.12 | | | | |
| BDL156 | 10852.6 | P | | | 0.15 | | | | |
| BDL156 | 10852.6 | Av | | | 1.15 | | | | |
| BDL156 | 10853.6 | P | | 0.07 | 0.01 | | | 0.24 | |
| BDL156 | 10853.6 | Av | | 1.34 | 1.71 | | | 1.22 | |
| BDL156 | 10854.4 | P | 0.11 | 0.11 | <0.01 | | | 0.01 | |
| BDL156 | 10854.4 | Av | 1.13 | 1.26 | 1.66 | | | 1.24 | |
| BDL156 | 10855.3 | P | | | 0.01 | | | 0.1 | |
| BDL156 | 10855.3 | Av | | | 1.35 | | | 1.2 | |
| BDL158 | 9973.3 | P | | | | 0.01 | 0.03 | 0.17 | 0.09 |
| BDL158 | 9973.3 | Av | | | | 1.21 | 1.27 | 1.1 | 1.21 |
| BDL158 | 9971.3 | P | 0.42 | 0.32 | 0.27 | | | | |
| BDL158 | 9971.3 | Av | 1.13 | 1.13 | 1.11 | | | | |
| BDL158 | 9973.1 | P | | | | 0.08 | 0.24 | 0.17 | 0.02 |
| BDL158 | 9973.1 | Av | | | | 1.27 | 1.16 | 1.13 | 1.37 |
| BDL158 | 9973.3 | P | | | | <0.01 | 0.02 | 0.06 | 0.01 |
| BDL158 | 9973.3 | Av | | | | 1.66 | 1.39 | 1.17 | 2.06 |
| BDL158 | 9974.2 | P | <0.01 | <0.01 | 0.09 | | | | |
| BDL158 | 9974.2 | Av | 1.68 | 1.58 | 1.23 | | | | |
| BDL158 | 9974.3 | P | <0.01 | <0.01 | 0.13 | | | | |
| BDL158 | 9974.3 | Av | 1.76 | 1.62 | 1.58 | | | | |
| BDL158 | 9971.3 | P | | 0.07 | 0.15 | | | 0.02 | |
| BDL158 | 9971.3 | Av | | 1.22 | 1.2 | | | 1.15 | |
| BDL158 | 9973.1 | P | 0.01 | 0.41 | 0.03 | <0.01 | <0.01 | 0.08 | 0.02 |
| BDL158 | 9973.1 | Av | 1.28 | 1.11 | 1.35 | 1.49 | 1.35 | 1.26 | 1.8 |
| BDL158 | 9973.3 | P | | | | <0.01 | <0.01 | <0.01 | 0.02 |
| BDL158 | 9973.3 | Av | | | | 1.36 | 1.52 | 1.39 | 1.51 |
| BDL160 | 10011.5 | P | 0.01 | 0.22 | 0.15 | | | | |
| BDL160 | 10011.5 | Av | 1.41 | 1.2 | 1.26 | | | | |
| BDL160 | 10011.5 | P | | | | | | | 0.45 |
| BDL160 | 10011.5 | Av | | | | | | | 1.25 |
| BDL160 | 10011.7 | P | | | | 0.04 | | | 0.01 |
| BDL160 | 10011.7 | Av | | | | 1.34 | | | 1.95 |

TABLE 21-continued

Results obtained in a tissue culture assay

| Gene | Ev. | Par. | Leaf Area TP1 | Leaf Area TP2 | Leaf Area TP3 | Roots Length TP1 | Roots Length TP2 | Roots Length TP3 | Roots Coverage TP1 |
|---|---|---|---|---|---|---|---|---|---|
| BDL160 | 10013.1 | P | | | 0.53 | | | | |
| BDL160 | 10013.1 | Av | | | 1.11 | | | | |
| BDL160 | 10014.9 | P | 0.2 | 0.39 | 0.61 | | | | |
| BDL160 | 10014.9 | Av | 1.17 | 1.15 | 1.11 | | | | |
| BDL160 | 10015.2 | P | | 0.07 | 0.12 | | | | |
| BDL160 | 10015.2 | Av | | 1.19 | 1.22 | | | | |
| BDL167 | 10042.3 | P | <0.01 | | | | | | |
| BDL167 | 10042.3 | Av | 1.3 | | | | | | |
| BDL167 | 10043.1 | P | <0.01 | 0.02 | 0.14 | | | | |
| BDL167 | 10043.1 | Av | 1.37 | 1.18 | 1.2 | | | | |
| BDL167 | 10043.2 | P | 0.06 | 0.13 | 0.03 | | | | |
| BDL167 | 10043.2 | Av | 1.61 | 1.29 | 1.23 | | | | |
| BDL167 | 10043.3 | P | 0.01 | 0.01 | <0.01 | | | 0.01 | |
| BDL167 | 10043.3 | Av | 1.93 | 1.58 | 1.61 | | | 1.25 | |
| BDL167 | 10044.2 | P | <0.01 | 0.01 | 0.02 | 0.05 | 0.04 | 0.03 | |
| BDL167 | 10044.2 | Av | 1.63 | 1.43 | 1.43 | 1.28 | 1.23 | 1.23 | |
| BDL167 | 10043.1 | P | <0.01 | <0.01 | 0.15 | | <0.01 | 0.12 | 0.47 |
| BDL167 | 10043.1 | Av | 1.56 | 1.53 | 1.43 | | 1.22 | 1.1 | 1.1 |
| BDL167 | 10044.2 | P | | | | <0.01 | <0.01 | | <0.01 |
| BDL167 | 10044.2 | Av | | | | 1.45 | 1.18 | | 2.16 |
| BDL168 | 9881.3 | P | | | | 0.15 | | | 0.04 |
| BDL168 | 9881.3 | Av | | | | 1.23 | | | 1.67 |
| BDL168 | 9881.4 | P | | | | <0.01 | <0.01 | <0.01 | 0.02 |
| BDL168 | 9881.4 | Av | | | | 1.89 | 1.72 | 1.38 | 2.28 |
| BDL168 | 9882.1 | P | | | | 0.01 | 0.01 | 0.04 | <0.01 |
| BDL168 | 9882.1 | Av | | | | 1.9 | 1.68 | 1.29 | 2.57 |
| BDL168 | 9883.3 | P | | | | | | | 0.2 |
| BDL168 | 9883.3 | Av | | | | | | | 1.38 |
| BDL168 | 9884.1 | P | | | | <0.01 | <0.01 | 0.02 | 0.02 |
| BDL168 | 9884.1 | Av | | | | 2.05 | 1.73 | 1.38 | 2.61 |
| BDL169 | 10744.2 | P | | | | 0.08 | 0.02 | 0.08 | 0.29 |
| BDL169 | 10744.2 | Av | | | | 1.24 | 1.23 | 1.19 | 1.11 |
| BDL169 | 10747.1 | P | | | | 0.03 | 0.09 | 0.13 | |
| BDL169 | 10747.1 | Av | | | | 1.15 | 1.12 | 1.11 | |
| BDL169 | 10747.5 | P | | | | 0.06 | 0.01 | <0.01 | 0.12 |
| BDL169 | 10747.5 | Av | | | | 1.62 | 1.59 | 1.4 | 1.73 |
| BDL171 | 10661.2 | P | | 0.25 | 0.28 | <0.01 | <0.01 | <0.01 | 0.03 |
| BDL171 | 10661.2 | Av | | 1.19 | 1.23 | 1.62 | 1.65 | 1.39 | 1.8 |
| BDL171 | 10661.5 | P | 0.02 | 0.04 | 0.12 | | | | |
| BDL171 | 10661.5 | Av | 1.45 | 1.35 | 1.24 | | | | |
| BDL171 | 10664.1 | P | 0.31 | 0.3 | 0.25 | 0.15 | 0.27 | 0.31 | 0.44 |
| BDL171 | 10664.1 | Av | 1.17 | 1.18 | 1.23 | 1.23 | 1.15 | 1.14 | 1.17 |
| BDL173 | 9951.2 | P | | 0.18 | | | 0.42 | | 0.3 |
| BDL173 | 9951.2 | Av | | 1.17 | | | 1.11 | | 1.17 |
| BDL173 | 9952.1 | P | | | | <0.01 | <0.01 | <0.01 | <0.01 |
| BDL173 | 9952.1 | Av | | | | 2.17 | 1.99 | 1.45 | 3.32 |
| BDL173 | 9952.2 | P | | 0.35 | | <0.01 | <0.01 | 0.01 | 0.02 |
| BDL173 | 9952.2 | Av | | 1.12 | | 1.72 | 1.63 | 1.24 | 2.07 |
| BDL174 | 11082.1 | P | | | | 0.2 | 0.06 | | 0.42 |
| BDL174 | 11082.1 | Av | | | | 1.14 | 1.17 | | 1.18 |
| BDL174 | 11083.1 | P | <0.01 | <0.01 | 0.07 | <0.01 | <0.01 | 0.01 | 0.01 |
| BDL174 | 11083.1 | Av | 1.64 | 1.32 | 1.2 | 1.78 | 1.67 | 1.39 | 1.66 |
| BDL174 | 11083.2 | P | 0.04 | 0.17 | 0.12 | | 0.14 | 0.18 | |
| BDL174 | 11083.2 | Av | 1.2 | 1.16 | 1.25 | | 1.34 | 1.32 | |
| BDL174 | 11084.1 | P | <0.01 | <0.01 | <0.01 | | 0.03 | 0.1 | 0.03 |
| BDL174 | 11084.1 | Av | 2.56 | 2.29 | 2.1 | | 1.31 | 1.31 | 1.68 |
| BDL174 | 11085.1 | P | | 0.41 | 0.07 | <0.01 | <0.01 | <0.01 | <0.01 |
| BDL174 | 11085.1 | Av | | 1.11 | 1.24 | 1.95 | 2.33 | 1.98 | 1.71 |
| BDL174 | 11083.2 | P | <0.01 | <0.01 | 0.01 | 0.3 | | | 0.31 |
| BDL174 | 11083.2 | Av | 1.41 | 1.35 | 1.21 | 1.16 | | | 1.27 |
| BDL174 | 11084.1 | P | | | | 0.15 | | | <0.01 |
| BDL174 | 11084.1 | Av | | | | 1.22 | | | 2.13 |
| BDL174 | 11085.1 | P | | | | <0.01 | 0.01 | 0.04 | 0.01 |
| BDL174 | 11085.1 | Av | | | | 2.04 | 1.36 | 1.16 | 2.33 |
| BDL176 | 9891.4 | P | 0.1 | 0.05 | 0.06 | | | | |
| BDL176 | 9891.4 | Av | 1.1 | 1.17 | 1.36 | | | | |
| BDL176 | 9893.2 | P | 0.04 | <0.01 | 0.27 | | | | |
| BDL176 | 9893.2 | Av | 1.28 | 1.26 | 1.22 | | | | |
| BDL176 | 9893.3 | P | | | | 0.38 | | | |
| BDL176 | 9893.3 | Av | | | | 1.13 | | | |
| BDL176 | 9893.2 | P | | | | 0.15 | | | |
| BDL176 | 9893.2 | Av | | | | 1.2 | | | |
| BDL176 | 9893.3 | P | 0.05 | 0.01 | | 0.36 | | | 0.16 |
| BDL176 | 9893.3 | Av | 1.42 | 1.34 | | 1.16 | | | 1.42 |

TABLE 21-continued

Results obtained in a tissue culture assay

| Gene | Ev. | Par. | Leaf Area TP1 | Leaf Area TP2 | Leaf Area TP3 | Roots Length TP1 | Roots Length TP2 | Roots Length TP3 | Roots Coverage TP1 |
|---|---|---|---|---|---|---|---|---|---|
| BDL177 | 10521.3 | P | | | | | | 0.23 | |
| BDL177 | 10521.3 | Av | | | | | | 1.16 | |
| BDL177 | 10524.2 | P | | | | 0.13 | | | |
| BDL177 | 10524.2 | Av | | | | 1.16 | | | |
| BDL181 | 11293.6 | P | | 0.32 | | | | | |
| BDL181 | 11293.6 | Av | | 1.18 | | | | | |
| BDL181 | 11294.7 | P | | 0.36 | | | | | |
| BDL181 | 11294.7 | Av | | 1.13 | | | | | |
| BDL181 | 11293.1 | P | | 0.6 | | | | | |
| BDL181 | 11293.1 | Av | | 1.11 | | | | | |
| BDL181 | 11293.6 | P | | 0.01 | <0.01 | | | | |
| BDL181 | 11293.6 | Av | | 1.2 | 1.27 | | | | |
| BDL181 | 11294.7 | P | | | | | 0.16 | 0.17 | |
| BDL181 | 11294.7 | Av | | | | | 1.1 | 1.1 | |
| BDL182 | 10691.8 | P | 0.03 | 0.07 | 0.16 | | | | |
| BDL182 | 10691.8 | Av | 1.32 | 1.24 | 1.18 | | | | |
| BDL182 | 10692.2 | P | 0.17 | 0.08 | 0.19 | | | | |
| BDL182 | 10692.2 | Av | 1.19 | 1.27 | 1.2 | | | | |
| BDL182 | 10693.3 | P | 0.01 | 0.07 | 0.1 | 0.17 | 0.1 | 0.11 | |
| BDL182 | 10693.3 | Av | 1.55 | 1.44 | 1.31 | 1.17 | 1.17 | 1.1 | |
| BDL182 | 10693.5 | P | 0.04 | 0.24 | 0.12 | <0.01 | <0.01 | <0.01 | 0.48 |
| BDL182 | 10693.5 | Av | 1.33 | 1.15 | 1.22 | 1.39 | 1.33 | 1.21 | 1.1 |
| BDL183 | 9943.4 | P | | | | 0.02 | 0.11 | | 0.02 |
| BDL183 | 9943.4 | Av | | | | 1.26 | 1.17 | | 1.61 |
| BDL183 | 9944.4 | P | | | | 0.01 | <0.01 | 0.02 | 0.36 |
| BDL183 | 9944.4 | Av | | | | 1.24 | 1.36 | 1.21 | 1.26 |
| BDL189 | 11351.2 | P | 0.05 | | | | | | |
| BDL189 | 11351.2 | Av | 1.17 | | | | | | |
| BDL189 | 11353.3 | P | 0.22 | 0.04 | 0.11 | | | | |
| BDL189 | 11353.3 | Av | 1.19 | 1.2 | 1.17 | | | | |
| BDL189 | 11353.5 | P | 0.26 | | | | | | |
| BDL189 | 11353.5 | Av | 1.1 | | | | | | |
| BDL189 | 11355.4 | P | 0.12 | 0.12 | 0.1 | | | | |
| BDL189 | 11355.4 | Av | 1.12 | 1.11 | 1.11 | | | | |
| BDL189 | 11356.7 | P | 0.27 | | | | | | |
| BDL189 | 11356.7 | Av | 1.11 | | | | | | |
| BDL196 | 10242.2 | P | 0.02 | 0.09 | | 0.05 | 0.03 | 0.09 | |
| BDL196 | 10242.2 | Av | 1.18 | 1.13 | | 1.29 | 1.28 | 1.16 | |
| BDL196 | 10243.4 | P | 0.09 | 0.25 | 0.24 | 0.13 | 0.05 | 0.17 | <0.01 |
| BDL196 | 10243.4 | Av | 1.16 | 1.23 | 1.24 | 1.11 | 1.25 | 1.15 | 1.74 |
| BDL196 | 10244.1 | P | <0.01 | 0.07 | | | 0.23 | | 0.21 |
| BDL196 | 10244.1 | Av | 1.21 | 1.19 | | | 1.22 | | 1.33 |
| BDL196 | 10243.3 | P | | | | 0.02 | | | 0.68 |
| BDL196 | 10243.3 | Av | | | | 1.16 | | | 1.1 |
| BDL196 | 10243.4 | P | | 0.01 | <0.01 | | | 0.23 | |
| BDL196 | 10243.4 | Av | | 1.24 | 1.49 | | | 1.12 | |
| BDL197 | 11362.2 | P | | | | 0.14 | | | |
| BDL197 | 11362.2 | Av | | | | 1.17 | | | |
| BDL197 | 11363.1 | P | | | | | | 0.04 | |
| BDL197 | 11363.1 | Av | | | | | | 1.17 | |
| BDL197 | 11363.6 | P | | 0.15 | | | | | |
| BDL197 | 11363.6 | Av | | 1.17 | | | | | |
| BDL197 | 11364.1 | P | | 0.08 | 0.01 | | | 0.09 | |
| BDL197 | 11364.1 | Av | | 1.14 | 1.42 | | | 1.15 | |
| BDL197 | 11364.5 | P | | 0.09 | 0.04 | | | | |
| BDL197 | 11364.5 | Av | | 1.12 | 1.25 | | | | |
| BDL197 | 11363.6 | P | | 0.2 | 0.07 | | | | |
| BDL197 | 11363.6 | Av | | 1.11 | 1.19 | | | | |
| BDL201 | 9961.2 | P | 0.02 | 0.18 | 0.39 | | | | |
| BDL201 | 9961.2 | Av | 1.41 | 1.18 | 1.18 | | | | |
| BDL201 | 9961.3 | P | 0.08 | 0.13 | | | | | |
| BDL201 | 9961.3 | Av | 1.21 | 1.28 | | | | | |
| BDL201 | 9961.4 | P | | | | 0.06 | 0.15 | 0.43 | 0.02 |
| BDL201 | 9961.4 | Av | | | | 1.37 | 1.25 | 1.11 | 1.76 |
| BDL201 | 9964.3 | P | | | | <0.01 | 0.01 | | 0.02 |
| BDL201 | 9964.3 | Av | | | | 1.34 | 1.24 | | 1.84 |
| BDL220 | 10331.2 | P | <0.01 | <0.01 | 0.15 | | | | |
| BDL220 | 10331.2 | Av | 1.75 | 1.37 | 1.15 | | | | |
| BDL220 | 10331.5 | P | 0.01 | 0.02 | 0.05 | | | | |
| BDL220 | 10331.5 | Av | 1.48 | 1.64 | 1.75 | | | | |
| BDL220 | 10334.2 | P | <0.01 | <0.01 | 0.04 | | | | |
| BDL220 | 10334.2 | Av | 1.58 | 1.37 | 1.21 | | | | |
| BDL221 | 10341.3 | P | 0.13 | 0.13 | 0.06 | | | | |
| BDL221 | 10341.3 | Av | 1.26 | 1.19 | 1.44 | | | | |

TABLE 21-continued

Results obtained in a tissue culture assay

| Gene | Ev. | Par. | Leaf Area TP1 | Leaf Area TP2 | Leaf Area TP3 | Roots Length TP1 | Roots Length TP2 | Roots Length TP3 | Roots Coverage TP1 |
|---|---|---|---|---|---|---|---|---|---|
| BDL221 | 10341.4 | P | <0.01 | 0.01 | <0.01 | | | | |
| BDL221 | 10341.4 | Av | 1.57 | 1.3 | 1.35 | | | | |
| BDL221 | 10343.3 | P | | 0.11 | 0.06 | 0.01 | <0.01 | <0.01 | 0.13 |
| BDL221 | 10343.3 | Av | | 1.1 | 1.16 | 1.37 | 1.4 | 1.4 | 1.55 |
| BDL221 | 10341.1 | P | 0.26 | 0.45 | 0.19 | | | | |
| BDL221 | 10341.1 | Av | 1.18 | 1.15 | 1.26 | | | | |
| BDL221 | 10342.1 | P | <0.01 | <0.01 | 0.02 | <0.01 | <0.01 | <0.01 | <0.01 |
| BDL221 | 10342.1 | Av | 1.9 | 1.46 | 1.32 | 2.02 | 2.08 | 1.68 | 4.31 |
| BDL221 | 10343.1 | P | 0.18 | 0.05 | 0.07 | 0.26 | <0.01 | <0.01 | <0.01 |
| BDL221 | 10343.1 | Av | 1.3 | 1.51 | 1.58 | 1.12 | 1.35 | 1.32 | 1.67 |
| BDL221 | 10343.3 | P | <0.01 | <0.01 | <0.01 | <0.01 | <0.01 | <0.01 | <0.01 |
| BDL221 | 10343.3 | Av | 2.7 | 1.8 | 1.59 | 1.75 | 2.12 | 1.87 | 2.4 |
| BDL221 | 10343.4 | P | 0.05 | 0.11 | 0.19 | 0.01 | <0.01 | 0.05 | 0.02 |
| BDL221 | 10343.4 | Av | 1.88 | 1.56 | 1.57 | 1.46 | 1.65 | 1.49 | 2.07 |
| BDL221 | 10344.3 | P | 0.02 | 0.01 | 0.05 | | 0.1 | 0.18 | <0.01 |
| BDL221 | 10344.3 | Av | 1.9 | 1.61 | 1.56 | | 1.14 | 1.12 | 1.63 |
| BDL223 | 10793.5 | P | | | | | | 0.11 | |
| BDL223 | 10793.5 | Av | | | | | | 1.14 | |
| BDL223 | 10793.8 | P | | | | 0.21 | 0.17 | 0.08 | |
| BDL223 | 10793.8 | Av | | | | 1.18 | 1.17 | 1.18 | |
| BDL223 | 10796.2 | P | <0.01 | 0.06 | | | | | |
| BDL223 | 10796.2 | Av | 1.22 | 1.14 | | | | | |
| BDL223 | 10791.1 | P | | | 0.07 | | 0.12 | 0.03 | |
| BDL223 | 10791.1 | Av | | | 1.21 | | 1.17 | 1.2 | |
| BDL223 | 10793.3 | P | 0.01 | 0.04 | 0.02 | | | 0.14 | |
| BDL223 | 10793.3 | Av | 1.33 | 1.3 | 1.55 | | | 1.18 | |
| BDL223 | 10793.5 | P | | | | | 0.07 | 0.04 | |
| BDL223 | 10793.5 | Av | | | | | 1.14 | 1.18 | |
| BDL223 | 10793.8 | P | | 0.08 | 0.08 | <0.01 | <0.01 | <0.01 | <0.01 |
| BDL223 | 10793.8 | Av | | 1.17 | 1.19 | 1.54 | 1.65 | 1.5 | 1.64 |
| BDL223 | 10796.1 | P | | | 0.11 | | | | |
| BDL223 | 10796.1 | Av | | | 1.15 | | | | |
| BDL224 | 10451.3 | P | | 0.29 | | | | | |
| BDL224 | 10451.3 | Av | | 1.11 | | | | | |
| BDL224 | 10451.5 | P | | | 0.1 | | | | |
| BDL224 | 10451.5 | Av | | | 1.15 | | | | |
| BDL224 | 10451.7 | P | <0.01 | <0.01 | 0.01 | 0.03 | 0.07 | 0.23 | 0.16 |
| BDL224 | 10451.7 | Av | 1.58 | 1.69 | 1.8 | 1.39 | 1.26 | 1.19 | 1.41 |
| BDL226 | 10861.2 | P | | | | | | 0.4 | |
| BDL226 | 10861.2 | Av | | | | | | 1.1 | |
| BDL227 | 11491.1 | P | | | | <0.01 | <0.01 | 0.03 | 0.01 |
| BDL227 | 11491.1 | Av | | | | 1.5 | 1.46 | 1.21 | 1.95 |
| BDL227 | 11491.3 | P | <0.01 | <0.01 | <0.01 | 0.01 | <0.01 | 0.02 | 0.04 |
| BDL227 | 11491.3 | Av | 2.12 | 1.6 | 1.42 | 1.64 | 1.65 | 1.56 | 2.26 |
| BDL227 | 11491.5 | P | <0.01 | <0.01 | 0.02 | <0.01 | <0.01 | 0.01 | <0.01 |
| BDL227 | 11491.5 | Av | 1.84 | 1.53 | 1.42 | 1.78 | 1.85 | 1.64 | 2.73 |
| BDL227 | 11492.5 | P | <0.01 | <0.01 | 0.01 | 0.26 | 0.03 | 0.04 | 0.01 |
| BDL227 | 11492.5 | Av | 2.13 | 1.91 | 1.72 | 1.17 | 1.48 | 1.32 | 1.58 |
| BDL227 | 11493.5 | P | <0.01 | <0.01 | 0.02 | 0.33 | <0.01 | <0.01 | 0.02 |
| BDL227 | 11493.5 | Av | 1.55 | 1.63 | 1.74 | 1.1 | 1.47 | 1.47 | 1.53 |
| BDL230 | 10671.3 | P | <0.01 | 0.06 | 0.01 | | | | |
| BDL230 | 10671.3 | Av | 1.36 | 1.44 | 1.81 | | | | |
| BDL230 | 10671.5 | P | | | | 0.33 | 0.49 | 0.46 | |
| BDL230 | 10671.5 | Av | | | | 1.22 | 1.16 | 1.11 | |
| BDL231 | 11111.1 | P | <0.01 | <0.01 | <0.01 | | | | |
| BDL231 | 11111.1 | Av | 1.55 | 1.53 | 1.51 | | | | |
| BDL231 | 11111.2 | P | 0.11 | 0.15 | 0.04 | 0.19 | | 0.04 | |
| BDL231 | 11111.2 | Av | 1.12 | 1.12 | 1.28 | 1.15 | | 1.19 | |
| BDL231 | 11111.3 | P | <0.01 | 0.04 | 0.05 | | | | |
| BDL231 | 11111.3 | Av | 1.35 | 1.26 | 1.37 | | | | |
| BDL231 | 11112.2 | P | <0.01 | 0.01 | 0.03 | <0.01 | <0.01 | <0.01 | 0.01 |
| BDL231 | 11112.2 | Av | 1.72 | 1.43 | 1.38 | 2.08 | 1.68 | 1.48 | 2.34 |
| BDL231 | 11116.5 | P | <0.01 | <0.01 | <0.01 | <0.01 | 0.01 | 0.03 | <0.01 |
| BDL231 | 11116.5 | Av | 1.82 | 1.77 | 1.76 | 1.67 | 1.38 | 1.31 | 1.92 |
| BDL231 | 11111.1 | P | <0.01 | <0.01 | <0.01 | | 0.36 | | 0.07 |
| BDL231 | 11111.1 | Av | 1.88 | 1.78 | 1.49 | | 1.11 | | 1.43 |
| BDL231 | 11111.2 | P | 0.01 | 0.03 | 0.01 | 0.01 | 0.1 | | 0.05 |
| BDL231 | 11111.2 | Av | 1.66 | 1.6 | 1.45 | 1.28 | 1.15 | | 1.51 |
| BDL231 | 11111.3 | P | | | | 0.01 | 0.26 | | 0.53 |
| BDL231 | 11111.3 | Av | | | | 1.31 | 1.1 | | 1.1 |
| BDL231 | 11112.2 | P | 0.24 | 0.17 | | <0.01 | <0.01 | | <0.01 |
| BDL231 | 11112.2 | Av | 1.12 | 1.12 | | 1.51 | 1.3 | | 1.97 |
| BDL231 | 11116.5 | P | | | | 0.11 | | | 0.24 |
| BDL231 | 11116.5 | Av | | | | 1.19 | | | 1.35 |

TABLE 21-continued

Results obtained in a tissue culture assay

| Gene | Ev. | Par. | Leaf Area TP1 | Leaf Area TP2 | Leaf Area TP3 | Roots Length TP1 | Roots Length TP2 | Roots Length TP3 | Roots Coverage TP1 |
|---|---|---|---|---|---|---|---|---|---|
| BDL232 | 10904.1 | P | | 0.61 | 0.54 | | 0.43 | 0.23 | |
| BDL232 | 10904.1 | Av | | 1.17 | 1.2 | | 1.1 | 1.14 | |
| BDL232 | 10905.1 | P | | | | 0.02 | <0.01 | 0.05 | 0.02 |
| BDL232 | 10905.1 | Av | | | | 1.5 | 1.46 | 1.25 | 1.4 |
| BDL232 | 10906.3 | P | | 0.25 | 0.14 | | 0.59 | 0.25 | |
| BDL232 | 10906.3 | Av | | 1.29 | 1.45 | | 1.1 | 1.21 | |
| BDL232 | 10902.2 | P | | | | <0.01 | <0.01 | 0.06 | 0.01 |
| BDL232 | 10902.2 | Av | | | | 1.7 | 1.47 | 1.24 | 2.1 |
| BDL232 | 10905.1 | P | | | | <0.01 | 0.01 | 0.09 | 0.03 |
| BDL232 | 10905.1 | Av | | | | 1.59 | 1.42 | 1.2 | 2.17 |
| BDL233 | 10825.4 | P | | | | <0.01 | <0.01 | <0.01 | <0.01 |
| BDL233 | 10825.4 | Av | | | | 1.47 | 1.45 | 1.35 | 2.01 |
| BDL233 | 10822.4 | P | | | 0.14 | | | | |
| BDL233 | 10822.4 | Av | | | 1.23 | | | | |
| BDL233 | 10824.2 | P | | | | | | 0.05 | |
| BDL233 | 10824.2 | Av | | | | | | 1.16 | |
| BDL233 | 10825.3 | P | | | | | | | 0.26 |
| BDL233 | 10825.3 | Av | | | | | | | 1.27 |
| BDL233 | 10825.4 | P | | | 0.24 | <0.01 | <0.01 | <0.01 | 0.19 |
| BDL233 | 10825.4 | Av | | | 1.17 | 1.56 | 1.59 | 1.51 | 1.3 |
| BDL235 | 11413.2 | P | | | | <0.01 | 0.01 | 0.03 | 0.18 |
| BDL235 | 11413.2 | Av | | | | 1.63 | 1.3 | 1.19 | 1.43 |
| BDL235 | 11413.2 | P | | | | <0.01 | <0.01 | 0.05 | 0.01 |
| BDL235 | 11413.2 | Av | | | | 1.57 | 1.45 | 1.29 | 2.12 |
| BDL237 | 10892.2 | P | 0.16 | | | | 0.28 | 0.12 | 0.09 |
| BDL237 | 10892.2 | Av | 1.21 | | | | 1.1 | 1.12 | 1.4 |
| BDL237 | 10893.1 | P | <0.01 | 0.02 | 0.14 | | 0.19 | 0.28 | |
| BDL237 | 10893.1 | Av | 1.96 | 1.39 | 1.24 | | 1.13 | 1.14 | |
| BDL237 | 10895.3 | P | <0.01 | <0.01 | 0.01 | 0.01 | <0.01 | <0.01 | 0.02 |
| BDL237 | 10895.3 | Av | 2.2 | 1.99 | 1.9 | 1.84 | 1.97 | 1.79 | 2.09 |
| BDL237 | 10896.1 | P | 0.19 | | 0.49 | | | | |
| BDL237 | 10896.1 | Av | 1.29 | | 1.1 | | | | |
| BDL238 | 10951.4 | P | | | | 0.08 | | | 0.01 |
| BDL238 | 10951.4 | Av | | | | 1.2 | | | 1.69 |
| BDL238 | 10952.3 | P | 0.05 | | | | | | |
| BDL238 | 10952.3 | Av | 1.2 | | | | | | |
| BDL238 | 10953.3 | P | | | | | | | 0.32 |
| BDL238 | 10953.3 | Av | | | | | | | 1.5 |
| BDL238 | 10954.2 | P | | | | 0.05 | | | 0.59 |
| BDL238 | 10954.2 | Av | | | | 1.24 | | | 1.13 |
| BDL238 | 10954.3 | P | 0.09 | | | 0.03 | 0.17 | 0.26 | 0.17 |
| BDL238 | 10954.3 | Av | 1.16 | | | 1.3 | 1.12 | 1.1 | 1.45 |
| BDL238 | 10951.4 | P | | | | 0.13 | 0.04 | 0.23 | 0.17 |
| BDL238 | 10951.4 | Av | | | | 1.22 | 1.24 | 1.11 | 1.39 |
| BDL238 | 10952.3 | P | | | | 0.02 | 0.01 | 0.02 | 0.11 |
| BDL238 | 10952.3 | Av | | | | 1.44 | 1.43 | 1.37 | 1.54 |
| BDL238 | 10954.2 | P | | | | 0.02 | 0.08 | 0.17 | 0.22 |
| BDL238 | 10954.2 | Av | | | | 1.26 | 1.2 | 1.17 | 1.2 |
| BDL240 | 10802.2 | P | <0.01 | 0.2 | 0.31 | | 0.16 | 0.1 | 0.1 |
| BDL240 | 10802.2 | Av | 1.57 | 1.23 | 1.17 | | 1.17 | 1.19 | 1.25 |
| BDL240 | 10803.5 | P | 0.11 | 0.4 | 0.31 | | | | |
| BDL240 | 10803.5 | Av | 1.4 | 1.11 | 1.16 | | | | |
| BDL240 | 10806.4 | P | <0.01 | 0.18 | | | | | |
| BDL240 | 10806.4 | Av | 1.29 | 1.16 | | | | | |
| BDL240 | 10806.6 | P | 0.02 | 0.02 | 0.04 | 0.02 | 0.01 | 0.01 | 0.03 |
| BDL240 | 10806.6 | Av | 2.29 | 1.87 | 1.52 | 1.59 | 1.63 | 1.49 | 3.75 |
| BDL241 | 10873.1 | P | | | | | | | 0.51 |
| BDL241 | 10873.1 | Av | | | | | | | 1.2 |
| BDL241 | 10874.3 | P | | | | | | | 0.32 |
| BDL241 | 10874.3 | Av | | | | | | | 1.42 |
| BDL241 | 10875.1 | P | | | | 0.04 | 0.01 | 0.13 | <0.01 |
| BDL241 | 10875.1 | Av | | | | 1.4 | 1.34 | 1.21 | 2.29 |
| BDL241 | 10874.3 | P | <0.01 | <0.01 | 0.02 | | | 0.1 | |
| BDL241 | 10874.3 | Av | 1.34 | 1.34 | 1.43 | | | 1.15 | |
| BDL241 | 10875.1 | P | | | | <0.01 | 0.03 | 0.3 | 0.03 |
| BDL241 | 10875.1 | Av | | | | 1.32 | 1.29 | 1.16 | 1.52 |
| BDL242 | 10731.3 | P | | 0.03 | | 0.06 | 0.18 | 0.11 | |
| BDL242 | 10731.3 | Av | | 1.12 | | 1.14 | 1.13 | 1.36 | |
| BDL242 | 10731.5 | P | | | | 0.4 | 0.11 | 0.18 | 0.32 |
| BDL242 | 10731.5 | Av | | | | 1.13 | 1.16 | 1.1 | 1.23 |
| BDL242 | 10731.2 | P | 0.36 | | | | | | |
| BDL242 | 10731.2 | Av | 1.2 | | | | | | |
| BDL242 | 10731.3 | P | <0.01 | <0.01 | <0.01 | | 0.02 | <0.01 | 0.03 |
| BDL242 | 10731.3 | Av | 3.13 | 2.79 | 2.3 | | 1.26 | 1.27 | 1.65 |

TABLE 21-continued

Results obtained in a tissue culture assay

| Gene | Ev. | Par. | Leaf Area TP1 | Leaf Area TP2 | Leaf Area TP3 | Roots Length TP1 | Roots Length TP2 | Roots Length TP3 | Roots Coverage TP1 |
|---|---|---|---|---|---|---|---|---|---|
| BDL242 | 10731.5 | P | 0.06 | | | 0.05 | 0.05 | | <0.01 |
| BDL242 | 10731.5 | Av | 1.45 | | | 1.21 | 1.16 | | 1.77 |
| BDL242 | 10731.7 | P | <0.01 | <0.01 | <0.01 | 0.04 | <0.01 | <0.01 | 0.14 |
| BDL242 | 10731.7 | Av | 2.48 | 1.8 | 1.61 | 1.36 | 1.41 | 1.3 | 1.72 |
| BDL242 | 10737.2 | P | 0.03 | 0.04 | <0.01 | | | 0.47 | |
| BDL242 | 10737.2 | Av | 2.07 | 1.86 | 1.9 | | | 1.1 | |
| BDL247 | 10911.1 | P | | | | <0.01 | 0.08 | 0.23 | |
| BDL247 | 10911.1 | Av | | | | 1.29 | 1.2 | 1.13 | |
| BDL247 | 10912.1 | P | | | | | | 0.24 | |
| BDL247 | 10912.1 | Av | | | | | | 1.13 | |
| BDL247 | 10912.6 | P | | | | | | | 0.19 |
| BDL247 | 10912.6 | Av | | | | | | | 1.19 |
| BDL247 | 10915.1 | P | | | 0.54 | | | 0.42 | |
| BDL247 | 10915.1 | Av | | | 1.11 | | | 1.12 | |
| BDL247 | 10911.1 | P | 0.01 | 0.05 | 0.02 | 0.02 | 0.06 | 0.05 | 0.05 |
| BDL247 | 10911.1 | Av | 2.19 | 1.85 | 1.68 | 1.46 | 1.53 | 1.46 | 2.05 |
| BDL247 | 10912.1 | P | <0.01 | <0.01 | 0.15 | | 0.21 | 0.22 | |
| BDL247 | 10912.1 | Av | 1.48 | 1.28 | 1.24 | | 1.11 | 1.12 | |
| BDL247 | 10912.2 | P | 0.02 | 0.01 | 0.01 | | 0.04 | <0.01 | |
| BDL247 | 10912.2 | Av | 1.66 | 1.57 | 1.41 | | 1.28 | 1.38 | |
| BDL247 | 10912.6 | P | | | | | 0.45 | 0.38 | 0.37 |
| BDL247 | 10912.6 | Av | | | | | 1.1 | 1.1 | 1.13 |
| BDL247 | 10915.1 | P | <0.01 | 0.01 | <0.01 | | | 0.35 | 0.25 |
| BDL247 | 10915.1 | Av | 2.22 | 2.04 | 1.88 | | | 1.15 | 1.29 |
| BDL248 | 11051.2 | P | 0.15 | 0.1 | 0.01 | 0.01 | 0.01 | <0.01 | 0.09 |
| BDL248 | 11051.2 | Av | 1.21 | 1.26 | 1.34 | 1.29 | 1.44 | 1.38 | 1.66 |
| BDL248 | 11052.2 | P | <0.01 | <0.01 | <0.01 | | 0.01 | <0.01 | 0.01 |
| BDL248 | 11052.2 | Av | 2.25 | 2.23 | 1.94 | | 1.35 | 1.33 | 1.39 |
| BDL248 | 11053.3 | P | 0.03 | 0.02 | 0.01 | <0.01 | 0.01 | 0.02 | <0.01 |
| BDL248 | 11053.3 | Av | 1.56 | 1.5 | 1.33 | 1.38 | 1.44 | 1.35 | 2.29 |
| BDL248 | 11054.3 | P | 0.38 | 0.4 | | | 0.21 | 0.09 | |
| BDL248 | 11054.3 | Av | 1.11 | 1.13 | | | 1.13 | 1.18 | |
| BDL248 | 11051.2 | P | | | | | 0.05 | | |
| BDL248 | 11051.2 | Av | | | | | 1.1 | | |
| BDL249 | 11401.2 | P | <0.01 | <0.01 | <0.01 | <0.01 | <0.01 | <0.01 | 0.01 |
| BDL249 | 11401.2 | Av | 3.01 | 2.92 | 2.73 | 1.78 | 1.84 | 1.71 | 3.51 |
| BDL249 | 11401.5 | P | <0.01 | <0.01 | <0.01 | <0.01 | <0.01 | <0.01 | <0.01 |
| BDL249 | 11401.5 | Av | 2.17 | 1.83 | 1.52 | 1.66 | 1.64 | 1.41 | 3.31 |
| BDL249 | 11402.4 | P | 0.01 | 0.01 | 0.03 | 0.18 | <0.01 | <0.01 | 0.04 |
| BDL249 | 11402.4 | Av | 1.49 | 1.44 | 1.39 | 1.14 | 1.64 | 1.49 | 1.54 |
| BDL249 | 11403.2 | P | | | 0.48 | | 0.19 | 0.26 | |
| BDL249 | 11403.2 | Av | | | 1.12 | | 1.2 | 1.16 | |
| BDL249 | 11404.3 | P | | | | 0.09 | 0.07 | 0.02 | 0.12 |
| BDL249 | 11404.3 | Av | | | | 1.41 | 1.4 | 1.26 | 1.57 |
| BDL249 | 11401.2 | P | | | | 0.29 | 0.2 | | 0.17 |
| BDL249 | 11401.2 | Av | | | | 1.11 | 1.1 | | 1.21 |
| BDL249 | 11401.5 | P | | | | 0.17 | | | 0.46 |
| BDL249 | 11401.5 | Av | | | | 1.2 | | | 1.21 |
| BDL249 | 11403.2 | P | | | | 0.04 | 0.15 | | 0.35 |
| BDL249 | 11403.2 | Av | | | | 1.3 | 1.13 | | 1.23 |
| BDL249 | 11404.3 | P | | | | 0.21 | 0.04 | 0.12 | 0.35 |
| BDL249 | 11404.3 | Av | | | | 1.11 | 1.27 | 1.19 | 1.14 |
| BDL250 | 10841.3 | P | | | | 0.01 | 0.12 | 0.17 | |
| BDL250 | 10841.3 | Av | | | | 1.26 | 1.23 | 1.12 | |
| BDL250 | 10842.3 | P | | 0.05 | 0.23 | <0.01 | <0.01 | <0.01 | 0.03 |
| BDL250 | 10842.3 | Av | | 1.16 | 1.12 | 1.55 | 1.5 | 1.38 | 1.39 |
| BDL250 | 10846.2 | P | | | | <0.01 | <0.01 | <0.01 | |
| BDL250 | 10846.2 | Av | | | | 1.36 | 1.37 | 1.29 | |
| BDL250 | 10846.3 | P | | | | 0.09 | <0.01 | <0.01 | 0.12 |
| BDL250 | 10846.3 | Av | | | | 1.33 | 1.39 | 1.29 | 1.44 |
| BDL250 | 10841.3 | P | 0.01 | 0.1 | 0.09 | <0.01 | <0.01 | <0.01 | 0.01 |
| BDL250 | 10841.3 | Av | 1.23 | 1.21 | 1.22 | 1.82 | 1.89 | 1.68 | 2.37 |
| BDL250 | 10842.3 | P | 0.05 | 0.15 | 0.26 | <0.01 | 0.23 | 0.48 | 0.02 |
| BDL250 | 10842.3 | Av | 1.73 | 1.59 | 1.5 | 1.4 | 1.26 | 1.14 | 2.03 |
| BDL250 | 10843.2 | P | 0.01 | 0.02 | 0.04 | <0.01 | 0.01 | 0.01 | <0.01 |
| BDL250 | 10843.2 | Av | 1.97 | 1.67 | 1.61 | 1.37 | 1.44 | 1.37 | 2.33 |
| BDL250 | 10846.2 | P | <0.01 | 0.01 | <0.01 | 0.11 | 0.02 | <0.01 | 0.08 |
| BDL250 | 10846.2 | Av | 2.3 | 1.59 | 1.69 | 1.21 | 1.33 | 1.36 | 1.39 |
| BDL250 | 10846.3 | P | <0.01 | <0.01 | <0.01 | 0.01 | <0.01 | <0.01 | 0.01 |
| BDL250 | 10846.3 | Av | 1.92 | 1.69 | 1.78 | 1.66 | 1.98 | 1.79 | 2.83 |
| BDL252 | 10881.1 | P | <0.01 | <0.01 | <0.01 | 0.13 | 0.01 | <0.01 | 0.04 |
| BDL252 | 10881.1 | Av | 1.96 | 1.94 | 1.72 | 1.29 | 1.48 | 1.42 | 1.52 |
| BDL252 | 10882.1 | P | <0.01 | <0.01 | <0.01 | 0.05 | 0.01 | 0.01 | 0.02 |
| BDL252 | 10882.1 | Av | 2.97 | 2.36 | 2.12 | 1.65 | 1.88 | 1.77 | 3.43 |

TABLE 21-continued

Results obtained in a tissue culture assay

| Gene | Ev. | Par. | Leaf Area TP1 | Leaf Area TP2 | Leaf Area TP3 | Roots Length TP1 | Roots Length TP2 | Roots Length TP3 | Roots Coverage TP1 |
|---|---|---|---|---|---|---|---|---|---|
| BDL252 | 10882.2 | P | <0.01 | <0.01 | <0.01 | 0.03 | 0.04 | <0.01 | 0.03 |
| BDL252 | 10882.2 | Av | 1.89 | 1.48 | 1.43 | 1.47 | 1.54 | 1.45 | 2.04 |
| BDL252 | 10882.4 | P | 0.03 | <0.01 | 0.11 | <0.01 | 0.01 | 0.03 | 0.01 |
| BDL252 | 10882.4 | Av | 1.64 | 1.4 | 1.3 | 1.7 | 1.48 | 1.31 | 2.99 |
| BDL252 | 10884.1 | P | <0.01 | 0.02 | 0.13 | | | | |
| BDL252 | 10884.1 | Av | 1.55 | 1.31 | 1.17 | | | | |
| BDL58 | 10281.5 | P | 0.23 | 0.48 | 0.16 | | | | |
| BDL58 | 10281.5 | Av | 1.25 | 1.18 | 1.3 | | | | |
| BDL58 | 10282.3 | P | <0.01 | <0.01 | 0.01 | 0.12 | <0.01 | <0.01 | 0.26 |
| BDL58 | 10282.3 | Av | 1.79 | 1.72 | 1.77 | 1.27 | 1.62 | 1.62 | 1.43 |
| BDL62 | 10682.1 | P | | | | | | | 0.53 |
| BDL62 | 10682.1 | Av | | | | | | | 1.16 |
| BDL62 | 10684.2 | P | | | | 0.01 | | | 0.22 |
| BDL62 | 10684.2 | Av | | | | 1.43 | | | 1.3 |
| BDL62 | 10682.1 | P | | 0.37 | 0.56 | | | | |
| BDL62 | 10682.1 | Av | | 1.17 | 1.16 | | | | |
| BDL62 | 10684.2 | P | | | | | | 0.09 | |
| BDL62 | 10684.2 | Av | | | | | | 1.13 | |
| BDL64 | 10651.5 | P | | 0.08 | 0.27 | | | | |
| BDL64 | 10651.5 | Av | | 1.26 | 1.56 | | | | |
| BDL64 | 10653.1 | P | 0.01 | 0.06 | 0.01 | | | | |
| BDL64 | 10653.1 | Av | 1.24 | 1.23 | 1.53 | | | | |
| BDL64 | 10654.3 | P | | 0.32 | 0.3 | 0.2 | 0.04 | 0.09 | |
| BDL64 | 10654.3 | Av | | 1.21 | 1.38 | 1.11 | 1.4 | 1.4 | |
| BDL64 | 10651.1 | P | | 0.53 | | | | | |
| BDL64 | 10651.1 | Av | | 1.11 | | | | | |
| BDL64 | 10653.1 | P | 0.11 | 0.02 | 0.05 | 0.01 | <0.01 | 0.01 | 0.14 |
| BDL64 | 10653.1 | Av | 1.34 | 1.57 | 1.61 | 1.34 | 1.42 | 1.28 | 1.34 |
| BDL64 | 10654.3 | P | 0.01 | <0.01 | <0.01 | <0.01 | <0.01 | 0.01 | 0.29 |
| BDL64 | 10654.3 | Av | 1.41 | 1.49 | 1.46 | 1.28 | 1.29 | 1.23 | 1.27 |
| BDL64 | 10651.1 | P | <0.01 | <0.01 | | 0.02 | 0.15 | | 0.2 |
| BDL64 | 10651.1 | Av | 1.5 | 1.31 | | 1.41 | 1.13 | | 1.44 |
| BDL64 | 10651.3 | P | | | | <0.01 | <0.01 | 0.13 | <0.01 |
| BDL64 | 10651.3 | Av | | | | 1.96 | 1.41 | 1.15 | 3.02 |
| BDL64 | 10653.1 | P | | | | 0.03 | 0.3 | | 0.08 |
| BDL64 | 10653.1 | Av | | | | 1.64 | 1.18 | | 1.64 |
| BDL64 | 10654.3 | P | | | | <0.01 | 0.22 | | 0.04 |
| BDL64 | 10654.3 | Av | | | | 1.82 | 1.23 | | 2.34 |
| BDL79 | 11041.1 | P | | | | | | | 0.62 |
| BDL79 | 11041.1 | Av | | | | | | | 1.12 |
| BDL79 | 11042.1 | P | | | | | | | 0.61 |
| BDL79 | 11042.1 | Av | | | | | | | 1.13 |
| BDL79 | 11043.1 | P | | | | | | | 0.08 |
| BDL79 | 11043.1 | Av | | | | | | | 1.64 |
| BDL79 | 11042.3 | P | | | | | | 0.33 | |
| BDL79 | 11042.3 | Av | | | | | | 1.12 | |
| BDL79 | 11043.1 | P | | | 0.04 | 0.17 | <0.01 | 0.01 | 0.37 |
| BDL79 | 11043.1 | Av | | | 1.23 | 1.19 | 1.36 | 1.29 | 1.19 |
| BDL81 | 10372.2 | P | <0.01 | 0.35 | 0.43 | | | | |
| BDL81 | 10372.2 | Av | 1.25 | 1.11 | 1.13 | | | | |
| BDL81 | 10374.1 | P | | | | | | | 0.3 |
| BDL81 | 10374.1 | Av | | | | | | | 1.24 |
| BDL85 | 10411.3 | P | | | | 0.08 | 0.03 | | |
| BDL85 | 10411.3 | Av | | | | 1.15 | 1.12 | | |
| BDL85 | 10414.1 | P | 0.2 | | 0.04 | | | | |
| BDL85 | 10414.1 | Av | 1.16 | | 1.26 | | | | |
| BDL85 | 10414.2 | P | 0.19 | 0.02 | <0.01 | | | | |
| BDL85 | 10414.2 | Av | 1.1 | 1.2 | 1.35 | | | | |
| BDL88 | 10291.2 | P | 0.01 | 0.03 | 0.03 | | | 0.07 | |
| BDL88 | 10291.2 | Av | 1.88 | 1.59 | 1.52 | | | 1.13 | |
| BDL88 | 10291.4 | P | 0.02 | <0.01 | <0.01 | | 0.03 | <0.01 | |
| BDL88 | 10291.4 | Av | 1.45 | 1.43 | 1.53 | | 1.21 | 1.28 | |
| BDL88 | 10291.5 | P | 0.12 | 0.15 | 0.37 | | | | 0.67 |
| BDL88 | 10291.5 | Av | 1.43 | 1.35 | 1.17 | | | | 1.11 |
| BDL88 | 10293.3 | P | <0.01 | <0.01 | <0.01 | | | | 0.57 |
| BDL88 | 10293.3 | Av | 2.76 | 2.34 | 2.24 | | | | 1.12 |
| BDL88 | 10291.2 | P | <0.01 | <0.01 | <0.01 | | | | |
| BDL88 | 10291.2 | Av | 1.64 | 1.57 | 1.58 | | | | |
| BDL88 | 10291.4 | P | <0.01 | <0.01 | <0.01 | | | | |
| BDL88 | 10291.4 | Av | 1.67 | 1.5 | 1.53 | | | | |
| BDL88 | 10291.5 | P | <0.01 | <0.01 | <0.01 | | | | |
| BDL88 | 10291.5 | Av | 1.8 | 1.7 | 1.84 | | | | |
| BDL88 | 10293.3 | P | 0.03 | 0.05 | 0.06 | | | | |
| BDL88 | 10293.3 | Av | 1.19 | 1.16 | 1.22 | | | | |

TABLE 21-continued

Results obtained in a tissue culture assay

| Gene | Ev. | Par. | Leaf Area TP1 | Leaf Area TP2 | Leaf Area TP3 | Roots Length TP1 | Roots Length TP2 | Roots Length TP3 | Roots Coverage TP1 |
|---|---|---|---|---|---|---|---|---|---|
| BDL88 | 10294.2 | P | <0.01 | 0.01 | 0.02 | | | | |
| BDL88 | 10294.2 | Av | 1.82 | 1.66 | 1.78 | | | | |
| BDL90 | 10924.2 | P | | | | 0.05 | 0.01 | <0.01 | 0.16 |
| BDL90 | 10924.2 | Av | | | | 1.43 | 1.55 | 1.48 | 1.9 |
| BDL90 | 10925.4 | P | | | | <0.01 | <0.01 | <0.01 | 0.07 |
| BDL90 | 10925.4 | Av | | | | 1.95 | 1.91 | 1.62 | 2.22 |
| BDL90 | 10924.2 | P | 0.12 | 0.2 | 0.09 | 0.02 | 0.01 | 0.01 | 0.04 |
| BDL90 | 10924.2 | Av | 1.32 | 1.23 | 1.22 | 1.31 | 1.31 | 1.31 | 1.93 |
| BDL90 | 10925.4 | P | 0.04 | 0.12 | | <0.01 | <0.01 | <0.01 | 0.02 |
| BDL90 | 10925.4 | Av | 1.25 | 1.15 | | 1.68 | 1.61 | 1.51 | 2.25 |
| BDL90 | 10921.6 | P | | | 0.1 | | | | |
| BDL90 | 10921.6 | Av | | | 1.19 | | | | |
| BDL90 | 10924.2 | P | | | 0.38 | <0.01 | <0.01 | <0.01 | 0.03 |
| BDL90 | 10924.2 | Av | | | 1.13 | 1.48 | 1.6 | 1.51 | 1.41 |
| BDL90 | 10925.4 | P | <0.01 | <0.01 | <0.01 | <0.01 | <0.01 | <0.01 | <0.01 |
| BDL90 | 10925.4 | Av | 1.6 | 1.66 | 1.8 | 1.85 | 1.81 | 1.71 | 2.9 |
| BDL94 | 11721.4 | P | 0.04 | 0.03 | 0.07 | | | | |
| BDL94 | 11721.4 | Av | 1.41 | 1.39 | 1.16 | | | | |
| BDL94 | 11725.2 | P | 0.04 | | | | | | |
| BDL94 | 11725.2 | Av | 1.16 | | | | | | |
| BDL94 | 11725.3 | P | 0.04 | | | | | | |
| BDL94 | 11725.3 | Av | 1.21 | | | | | | |
| BDL94 | 11725.5 | P | 0.14 | | | | | | |
| BDL94 | 11725.5 | Av | 1.1 | | | | | | |
| BDL94 | 11725.3 | P | 0.01 | | | | | | |
| BDL94 | 11725.3 | Av | 1.29 | | | | | | |

Table 21.
"P" = P-value;
"Av" = ratio between the averages of event and control. Note that when the average ratio is higher than "1" the effect of exogenous expression of the gene is an increase of the desired trait;
"Par" = Parameter according to the measured parameters;
"Ev" = event.
TP1 = Time point 1;
TP2 = Time point 2;
TP3 = Time point 3.

TABLE 22

Results obtained in a tissue culture assay

| Gene | Ev. | Par. | Roots Coverage TP2 | Roots Coverage TP3 | RGR Of Leaf Area | RGR Of Root Coverage | RGR Of Roots Length | Fresh Weight | Dry Weight |
|---|---|---|---|---|---|---|---|---|---|
| BDL102 | 10471.1 | P | 0.08 | 0.05 | | 0.11 | 0.36 | | |
| BDL102 | 10471.1 | Av | 1.58 | 1.35 | | 1.26 | 1.11 | | |
| BDL102 | 10471.3 | P | 0.08 | 0.15 | | 0.02 | 0.15 | | |
| BDL102 | 10471.3 | Av | 1.72 | 1.58 | | 1.57 | 1.18 | | |
| BDL102 | 10472.1 | P | 0.19 | 0.28 | | 0.25 | | 0.29 | |
| BDL102 | 10472.1 | Av | 1.28 | 1.22 | | 1.19 | | 1.18 | |
| BDL102 | 10474.2 | P | 0.33 | 0.16 | 0.01 | 0.02 | 0.07 | 0.21 | 0.26 |
| BDL102 | 10474.2 | Av | 1.22 | 1.38 | 1.4 | 1.44 | 1.19 | 1.53 | 1.5 |
| BDL102 | 10474.6 | P | | 0.2 | 0.31 | 0.14 | | | |
| BDL102 | 10474.6 | Av | | 1.19 | 1.15 | 1.22 | | | |
| BDL118 | 10481.2 | P | 0.13 | 0.24 | <0.01 | 0.14 | 0.28 | 0.03 | 0.01 |
| BDL118 | 10481.2 | Av | 1.2 | 1.19 | 1.99 | 1.23 | 1.15 | 2.14 | 1.99 |
| BDL118 | 10481.5 | P | | | 0.01 | | | 0.02 | 0.01 |
| BDL118 | 10481.5 | Av | | | 1.36 | | | 2.03 | 1.97 |
| BDL118 | 10483.4 | P | | | | | | 0.07 | 0.03 |
| BDL118 | 10483.4 | Av | | | | | | 1.93 | 1.65 |
| BDL118 | 10484.3 | P | | | <0.01 | | | <0.01 | <0.01 |
| BDL118 | 10484.3 | Av | | | 1.6 | | | 1.98 | 2.01 |
| BDL140 | 10421.3 | P | 0.14 | 0.06 | <0.01 | <0.01 | | 0.03 | 0.13 |
| BDL140 | 10421.3 | Av | 1.45 | 1.64 | 1.7 | 1.68 | | 1.81 | 1.57 |
| BDL140 | 10423.1 | P | 0.21 | 0.28 | 0.22 | 0.16 | | 0.41 | 0.33 |
| BDL140 | 10423.1 | Av | 1.31 | 1.25 | 1.21 | 1.25 | | 1.17 | 1.16 |
| BDL140 | 10424.4 | P | | 0.18 | <0.01 | 0.2 | | 0.08 | 0.45 |
| BDL140 | 10424.4 | Av | | 1.13 | 1.66 | 1.18 | | 1.46 | 1.2 |
| BDL152 | 10431.4 | P | | 0.21 | 0.24 | 0.13 | | 0.23 | 0.02 |
| BDL152 | 10431.4 | Av | | 1.23 | 1.18 | 1.27 | | 1.18 | 1.27 |
| BDL152 | 10432.5 | P | 0.1 | 0.04 | | 0.03 | | | |

TABLE 22-continued

Results obtained in a tissue culture assay

| Gene | Ev. | Par. | Roots Coverage TP2 | Roots Coverage TP3 | RGR Of Leaf Area | RGR Of Root Coverage | RGR Of Roots Length | Fresh Weight | Dry Weight |
|---|---|---|---|---|---|---|---|---|---|
| BDL152 | 10432.5 | Av | 1.25 | 1.31 | | 1.32 | | | |
| BDL152 | 10434.4 | P | 0.02 | <0.01 | | <0.01 | 0.03 | | |
| BDL152 | 10434.4 | Av | 1.76 | 1.51 | | 1.44 | 1.23 | | |
| BDL153 | 10142.2 | P | 0.04 | 0.58 | | | | | |
| BDL153 | 10142.2 | Av | 1.57 | 1.1 | | | | | |
| BDL153 | 10144.1 | P | 0.09 | 0.12 | 0.02 | 0.09 | 0.12 | 0.36 | |
| BDL153 | 10144.1 | Av | 1.51 | 1.32 | 1.42 | 1.35 | 1.18 | 1.18 | |
| BDL154 | 10703.1 | P | 0.38 | 0.47 | | 0.52 | 0.44 | | |
| BDL154 | 10703.1 | Av | 1.13 | 1.18 | | 1.15 | 1.13 | | |
| BDL154 | 10703.3 | P | | | | | 0.34 | | |
| BDL154 | 10703.3 | Av | | | | | 1.17 | | |
| BDL154 | 10703.5 | P | | | | | | 0.38 | 0.16 |
| BDL154 | 10703.5 | Av | | | | | | 1.11 | 1.16 |
| BDL154 | 10703.1 | P | 0.03 | 0.05 | <0.01 | 0.01 | 0.01 | 0.01 | 0.01 |
| BDL154 | 10703.1 | Av | 1.48 | 1.55 | 1.71 | 1.7 | 1.37 | 1.36 | 1.57 |
| BDL154 | 10703.5 | P | 0.1 | 0.04 | 0.11 | 0.01 | <0.01 | 0.34 | 0.11 |
| BDL154 | 10703.5 | Av | 1.75 | 1.7 | 1.29 | 1.73 | 1.59 | 1.24 | 1.38 |
| BDL154 | 10703.6 | P | 0.07 | 0.04 | | 0.07 | 0.14 | | |
| BDL154 | 10703.6 | Av | 1.63 | 1.47 | | 1.45 | 1.28 | | |
| BDL155 | 9991.2 | P | | | | | | 0.22 | 0.45 |
| BDL155 | 9991.2 | Av | | | | | | 1.44 | 1.27 |
| BDL155 | 9993.2 | P | | | | | | 0.55 | |
| BDL155 | 9993.2 | Av | | | | | | 1.45 | |
| BDL155 | 9994.4 | P | | | | | 0.19 | | |
| BDL155 | 9994.4 | Av | | | | | 1.13 | | |
| BDL156 | 10852.6 | P | 0.41 | 0.51 | | 0.19 | 0.09 | | |
| BDL156 | 10852.6 | Av | 1.1 | 1.12 | | 1.21 | 1.22 | | |
| BDL156 | 10852.7 | P | | | | | 0.35 | | |
| BDL156 | 10852.7 | Av | | | | | 1.13 | | |
| BDL156 | 10853.6 | P | 0.58 | 0.25 | 0.07 | 0.07 | 0.16 | 0.28 | 0.04 |
| BDL156 | 10853.6 | Av | 1.13 | 1.24 | 1.21 | 1.33 | 1.19 | 1.2 | 1.26 |
| BDL156 | 10852.6 | P | | | 0.05 | 0.59 | 0.33 | 0.35 | 0.21 |
| BDL156 | 10852.6 | Av | | | 1.29 | 1.13 | 1.16 | 1.12 | 1.24 |
| BDL156 | 10853.6 | P | 0.42 | 0.25 | <0.01 | 0.05 | 0.06 | <0.01 | 0.01 |
| BDL156 | 10853.6 | Av | 1.29 | 1.69 | 1.97 | 1.83 | 1.43 | 1.78 | 2.26 |
| BDL156 | 10854.4 | P | | 0.03 | <0.01 | <0.01 | <0.01 | <0.01 | <0.01 |
| BDL156 | 10854.4 | Av | | 1.59 | 1.87 | 1.76 | 1.53 | 1.61 | 1.94 |
| BDL156 | 10855.3 | P | 0.32 | <0.01 | <0.01 | <0.01 | 0.01 | 0.46 | 0.05 |
| BDL156 | 10855.3 | Av | 1.17 | 1.78 | 1.49 | 1.99 | 1.44 | 1.18 | 1.42 |
| BDL158 | 9973.3 | P | 0.26 | | | | | | |
| BDL158 | 9973.3 | Av | 1.22 | | | | | | |
| BDL158 | 9971.3 | P | | 0.12 | 0.45 | 0.03 | 0.3 | | |
| BDL158 | 9971.3 | Av | | 1.27 | 1.11 | 1.34 | 1.11 | | |
| BDL158 | 9973.1 | P | | 0.04 | | 0.1 | | | |
| BDL158 | 9973.1 | Av | | 1.25 | | 1.24 | | | |
| BDL158 | 9973.3 | P | 0.04 | 0.27 | | 0.32 | | | |
| BDL158 | 9973.3 | Av | 1.43 | 1.23 | | 1.16 | | | |
| BDL158 | 9974.2 | P | 0.01 | 0.03 | 0.34 | <0.01 | | | 0.49 |
| BDL158 | 9974.2 | Av | 1.48 | 1.41 | 1.14 | 1.45 | | | 1.1 |
| BDL158 | 9974.3 | P | 0.08 | 0.05 | 0.02 | <0.01 | | 0.01 | 0.01 |
| BDL158 | 9974.3 | Av | 1.5 | 1.49 | 1.54 | 1.54 | | 1.5 | 1.54 |
| BDL158 | 9971.3 | P | | 0.33 | 0.06 | 0.13 | <0.01 | | |
| BDL158 | 9971.3 | Av | | 1.13 | 1.25 | 1.24 | 1.46 | | |
| BDL158 | 9973.1 | P | 0.09 | 0.25 | 0.02 | 0.45 | 0.29 | | 0.16 |
| BDL158 | 9973.1 | Av | 1.22 | 1.22 | 1.37 | 1.13 | 1.13 | | 1.2 |
| BDL158 | 9973.3 | P | 0.02 | 0.1 | | 0.03 | <0.01 | | |
| BDL158 | 9973.3 | Av | 1.62 | 1.43 | | 1.42 | 1.4 | | |
| BDL158 | 9974.2 | P | 0.06 | 0.02 | | 0.03 | | | |
| BDL158 | 9974.2 | Av | 1.21 | 1.24 | | 1.32 | | | |
| BDL158 | 9974.3 | P | | | 0.51 | | | | |
| BDL158 | 9974.3 | Av | | | 1.11 | | | | |
| BDL160 | 10011.5 | P | | | 0.24 | | | <0.01 | 0.53 |
| BDL160 | 10011.5 | Av | | | 1.23 | | | 1.48 | 1.33 |
| BDL160 | 10011.6 | P | | | | | | 0.51 | 0.66 |
| BDL160 | 10011.6 | Av | | | | | | 1.18 | 1.1 |
| BDL160 | 10011.7 | P | | | | | | 0.56 | |
| BDL160 | 10011.7 | Av | | | | | | 1.28 | |
| BDL160 | 10015.1 | P | | | | | | 0.03 | 0.12 |
| BDL160 | 10015.1 | Av | | | | | | 1.57 | 1.25 |
| BDL160 | 10011.5 | P | 0.61 | 0.38 | | 0.42 | | | |
| BDL160 | 10011.5 | Av | 1.11 | 1.14 | | 1.14 | | | |
| BDL160 | 10013.1 | P | | | 0.32 | | | | |
| BDL160 | 10013.1 | Av | | | 1.16 | | | | |

TABLE 22-continued

Results obtained in a tissue culture assay

| Gene | Ev. | Par. | Roots Coverage TP2 | Roots Coverage TP3 | RGR Of Leaf Area | RGR Of Root Coverage | RGR Of Roots Length | Fresh Weight | Dry Weight |
|---|---|---|---|---|---|---|---|---|---|
| BDL160 | 10014.9 | P | | 0.52 | | 0.37 | | | |
| BDL160 | 10014.9 | Av | | 1.16 | | 1.18 | | | |
| BDL160 | 10015.2 | P | | | 0.05 | | | 0.1 | 0.11 |
| BDL160 | 10015.2 | Av | | | 1.28 | | | 1.29 | 1.42 |
| BDL167 | 10042.3 | P | | | | | 0.12 | | |
| BDL167 | 10042.3 | Av | | | | | 1.17 | | |
| BDL167 | 10043.1 | P | | 0.58 | 0.13 | 0.21 | 0.23 | | |
| BDL167 | 10043.1 | Av | | 1.17 | 1.16 | 1.25 | 1.18 | | |
| BDL167 | 10043.2 | P | | | 0.18 | 0.34 | 0.09 | | |
| BDL167 | 10043.2 | Av | | | 1.14 | 1.1 | 1.19 | | |
| BDL167 | 10043.3 | P | 0.1 | <0.01 | <0.01 | <0.01 | <0.01 | | |
| BDL167 | 10043.3 | Av | 1.27 | 1.67 | 1.54 | 1.79 | 1.46 | | |
| BDL167 | 10044.2 | P | 0.05 | <0.01 | <0.01 | <0.01 | 0.08 | | 0.61 |
| BDL167 | 10044.2 | Av | 1.26 | 1.48 | 1.38 | 1.55 | 1.2 | | 1.12 |
| BDL167 | 10043.1 | P | <0.01 | 0.17 | 0.04 | 0.16 | 0.14 | 0.06 | |
| BDL167 | 10043.1 | Av | 1.63 | 1.27 | 1.4 | 1.3 | 1.17 | 1.6 | |
| BDL167 | 10044.2 | P | 0.01 | | | | | | |
| BDL167 | 10044.2 | Av | 1.39 | | | | | | |
| BDL168 | 9881.4 | P | <0.01 | 0.14 | | 0.08 | 0.05 | | |
| BDL168 | 9881.4 | Av | 1.74 | 1.47 | | 1.42 | 1.21 | | |
| BDL168 | 9882.1 | P | 0.08 | 0.69 | | | | | |
| BDL168 | 9882.1 | Av | 1.85 | 1.11 | | | | | |
| BDL168 | 9884.1 | P | <0.01 | 0.11 | | 0.34 | 0.22 | | |
| BDL168 | 9884.1 | Av | 1.84 | 1.29 | | 1.2 | 1.15 | | |
| BDL169 | 10744.2 | P | 0.02 | 0.17 | | 0.13 | 0.24 | | |
| BDL169 | 10744.2 | Av | 1.34 | 1.21 | | 1.22 | 1.16 | | |
| BDL169 | 10747.1 | P | 0.39 | | | 0.4 | | | |
| BDL169 | 10747.1 | Av | 1.1 | | | 1.11 | | | |
| BDL169 | 10747.5 | P | 0.04 | 0.02 | | 0.02 | 0.07 | | |
| BDL169 | 10747.5 | Av | 1.59 | 1.41 | | 1.37 | 1.28 | | |
| BDL171 | 10661.2 | P | 0.03 | 0.01 | 0.19 | <0.01 | 0.01 | 0.06 | 0.02 |
| BDL171 | 10661.2 | Av | 2.26 | 2.17 | 1.28 | 2.22 | 1.3 | 1.73 | 2.47 |
| BDL171 | 10661.5 | P | | 0.14 | 0.32 | 0.04 | | 0.02 | <0.01 |
| BDL171 | 10661.5 | Av | | 1.33 | 1.19 | 1.38 | | 1.35 | 2.02 |
| BDL171 | 10662.3 | P | | 0.32 | | 0.19 | | | 0.56 |
| BDL171 | 10662.3 | Av | | 1.12 | | 1.18 | | | 1.13 |
| BDL171 | 10663.3 | P | | | | 0.45 | | | 0.39 |
| BDL171 | 10663.3 | Av | | | | 1.14 | | | 1.19 |
| BDL171 | 10664.1 | P | | 0.26 | 0.25 | 0.1 | 0.46 | 0.03 | 0.03 |
| BDL171 | 10664.1 | Av | | 1.33 | 1.24 | 1.35 | 1.1 | 1.39 | 1.89 |
| BDL173 | 9951.2 | P | 0.37 | | | | 0.27 | | |
| BDL173 | 9951.2 | Av | 1.32 | | | | 1.43 | | |
| BDL173 | 9952.1 | P | 0.04 | 0.02 | | 0.01 | 0.08 | | |
| BDL173 | 9952.1 | Av | 2.68 | 1.72 | | 1.61 | 1.21 | | |
| BDL173 | 9952.2 | P | 0.15 | 0.56 | | | | | |
| BDL173 | 9952.2 | Av | 1.44 | 1.11 | | | | | |
| BDL173 | 9954.3 | P | | | | | | 0.14 | |
| BDL173 | 9954.3 | Av | | | | | | 1.46 | |
| BDL174 | 11082.1 | P | 0.29 | 0.39 | | 0.43 | 0.05 | | |
| BDL174 | 11082.1 | Av | 1.24 | 1.15 | | 1.14 | 1.26 | | |
| BDL174 | 11083.1 | P | 0.07 | 0.11 | 0.41 | 0.05 | 0.15 | 0.48 | 0.37 |
| BDL174 | 11083.1 | Av | 1.76 | 1.43 | 1.13 | 1.42 | 1.21 | 1.1 | 1.2 |
| BDL174 | 11083.2 | P | 0.17 | 0.25 | 0.13 | 0.09 | 0.04 | 0.2 | 0.4 |
| BDL174 | 11083.2 | Av | 1.27 | 1.36 | 1.26 | 1.38 | 1.44 | 1.21 | 1.19 |
| BDL174 | 11084.1 | P | 0.04 | 0.06 | <0.01 | <0.01 | 0.01 | 0.06 | 0.05 |
| BDL174 | 11084.1 | Av | 2.13 | 1.94 | 2.01 | 1.96 | 1.42 | 2.06 | 2.27 |
| BDL174 | 11085.1 | P | <0.01 | <0.01 | 0.1 | <0.01 | <0.01 | 0.2 | 0.24 |
| BDL174 | 11085.1 | Av | 2.66 | 2.13 | 1.27 | 2.17 | 2 | 1.24 | 1.37 |
| BDL174 | 11083.2 | P | | | 0.19 | | | 0.12 | 0.29 |
| BDL174 | 11083.2 | Av | | | 1.15 | | | 1.2 | 1.14 |
| BDL174 | 11084.1 | P | 0.6 | | | | | | |
| BDL174 | 11084.1 | Av | 1.1 | | | | | | |
| BDL174 | 11085.1 | P | 0.05 | 0.32 | | | | | |
| BDL174 | 11085.1 | Av | 1.42 | 1.14 | | | | | |
| BDL176 | 9891.4 | P | | 0.67 | 0.01 | 0.47 | | 0.06 | |
| BDL176 | 9891.4 | Av | | 1.11 | 1.45 | 1.17 | | 2.02 | |
| BDL176 | 9893.2 | P | 0.21 | 0.4 | 0.22 | 0.26 | | 0.15 | |
| BDL176 | 9893.2 | Av | 1.37 | 1.22 | 1.21 | 1.25 | | 1.38 | |
| BDL176 | 9893.3 | P | 0.47 | 0.23 | | 0.12 | | 0.14 | 0.48 |
| BDL176 | 9893.3 | Av | 1.17 | 1.31 | | 1.3 | | 1.29 | 1.22 |
| BDL177 | 10521.3 | P | 0.66 | 0.34 | | 0.28 | 0.06 | | |
| BDL177 | 10521.3 | Av | 1.1 | 1.15 | | 1.17 | 1.3 | | |
| BDL181 | 11293.6 | P | | 0.59 | 0.1 | 0.37 | 0.45 | 0.39 | 0.37 |

TABLE 22-continued

Results obtained in a tissue culture assay

| Gene | Ev. | Par. | Roots Coverage TP2 | Roots Coverage TP3 | RGR Of Leaf Area | RGR Of Root Coverage | RGR Of Roots Length | Fresh Weight | Dry Weight |
|---|---|---|---|---|---|---|---|---|---|
| BDL181 | 11293.6 | Av | | 1.15 | 1.3 | 1.24 | 1.15 | 1.17 | 1.26 |
| BDL181 | 11294.7 | P | | | 0.04 | | 0.12 | 0.11 | 0.1 |
| BDL181 | 11294.7 | Av | | | 1.36 | | 1.28 | 1.26 | 1.38 |
| BDL181 | 11293.1 | P | | | 0.25 | 0.4 | 0.02 | 0.05 | 0.02 |
| BDL181 | 11293.1 | Av | | | 1.19 | 1.11 | 1.22 | 1.59 | 1.58 |
| BDL181 | 11293.6 | P | 0.23 | 0.15 | <0.01 | 0.09 | 0.03 | <0.01 | <0.01 |
| BDL181 | 11293.6 | Av | 1.23 | 1.22 | 1.34 | 1.25 | 1.18 | 1.48 | 1.45 |
| BDL181 | 11294.7 | P | 0.02 | 0.21 | 0.3 | 0.05 | 0.01 | | 0.57 |
| BDL181 | 11294.7 | Av | 1.55 | 1.26 | 1.11 | 1.3 | 1.23 | | 1.1 |
| BDL182 | 10691.8 | P | | | 0.42 | | | 0.06 | 0.01 |
| BDL182 | 10691.8 | Av | | | 1.15 | | | 1.53 | 2.11 |
| BDL182 | 10692.2 | P | 0.53 | 0.2 | 0.28 | 0.07 | | 0.28 | 0.15 |
| BDL182 | 10692.2 | Av | 1.12 | 1.21 | 1.21 | 1.28 | | 1.47 | 1.93 |
| BDL182 | 10692.3 | P | | 0.63 | | 0.3 | 0.43 | | |
| BDL182 | 10692.3 | Av | | 1.13 | | 1.21 | 1.1 | | |
| BDL182 | 10693.3 | P | 0.02 | 0.03 | 0.22 | <0.01 | | 0.17 | 0.01 |
| BDL182 | 10693.3 | Av | 1.37 | 1.55 | 1.25 | 1.62 | | 1.41 | 1.88 |
| BDL182 | 10693.5 | P | 0.02 | <0.01 | 0.32 | <0.01 | 0.13 | 0.06 | 0.01 |
| BDL182 | 10693.5 | Av | 1.47 | 1.72 | 1.19 | 1.8 | 1.13 | 1.38 | 1.91 |
| BDL183 | 9943.4 | P | 0.19 | 0.3 | | 0.48 | | | |
| BDL183 | 9943.4 | Av | 1.3 | 1.16 | | 1.13 | | | |
| BDL183 | 9944.4 | P | 0.02 | 0.52 | | 0.46 | 0.06 | 0.44 | |
| BDL183 | 9944.4 | Av | 1.37 | 1.15 | | 1.15 | 1.2 | 1.16 | |
| BDL189 | 11353.3 | P | | 0.17 | 0.18 | 0.18 | | | 0.46 |
| BDL189 | 11353.3 | Av | | 1.18 | 1.16 | 1.2 | | | 1.1 |
| BDL189 | 11351.2 | P | | | 0.43 | | | | 0.4 |
| BDL189 | 11351.2 | Av | | | 1.1 | | | | 1.17 |
| BDL189 | 11353.3 | P | | 0.24 | 0.22 | 0.11 | | | 0.33 |
| BDL189 | 11353.3 | Av | | 1.15 | 1.11 | 1.22 | | | 1.1 |
| BDL189 | 11353.5 | P | | | | | | 0.65 | |
| BDL189 | 11353.5 | Av | | | | | | 1.1 | |
| BDL189 | 11355.4 | P | | | 0.22 | | | 0.28 | 0.32 |
| BDL189 | 11355.4 | Av | | | 1.11 | | | 1.36 | 1.13 |
| BDL196 | 10242.2 | P | | | | | 0.28 | 0.49 | |
| BDL196 | 10242.2 | Av | | | | | 1.13 | 1.15 | |
| BDL196 | 10243.4 | P | <0.01 | 0.12 | 0.12 | 0.13 | 0.17 | 0.57 | |
| BDL196 | 10243.4 | Av | 1.45 | 1.36 | 1.27 | 1.34 | 1.17 | 1.11 | |
| BDL196 | 10244.1 | P | 0.16 | 0.43 | | 0.28 | | 0.02 | |
| BDL196 | 10244.1 | Av | 1.65 | 1.27 | | 1.27 | | 1.45 | |
| BDL196 | 10242.2 | P | | | 0.47 | | | | |
| BDL196 | 10242.2 | Av | | | 1.1 | | | | |
| BDL196 | 10243.3 | P | | | 0.6 | | | 0.43 | 0.23 |
| BDL196 | 10243.3 | Av | | | 1.1 | | | 1.13 | 1.23 |
| BDL196 | 10243.4 | P | 0.51 | 0.15 | <0.01 | 0.11 | 0.16 | 0.13 | 0.03 |
| BDL196 | 10243.4 | Av | 1.12 | 1.23 | 1.65 | 1.27 | 1.18 | 1.42 | 1.69 |
| BDL197 | 11362.2 | P | | 0.33 | 0.03 | 0.18 | 0.14 | | 0.38 |
| BDL197 | 11362.2 | Av | | 1.18 | 1.35 | 1.32 | 1.24 | | 1.19 |
| BDL197 | 11363.1 | P | | 0.23 | | 0.12 | <0.01 | | |
| BDL197 | 11363.1 | Av | | 1.25 | | 1.38 | 1.53 | | |
| BDL197 | 11363.6 | P | 0.39 | 0.01 | 0.05 | <0.01 | 0.04 | 0.02 | 0.04 |
| BDL197 | 11363.6 | Av | 1.19 | 1.59 | 1.31 | 1.77 | 1.36 | 1.41 | 1.61 |
| BDL197 | 11364.1 | P | | 0.04 | <0.01 | <0.01 | <0.01 | 0.08 | <0.01 |
| BDL197 | 11364.1 | Av | | 1.67 | 1.63 | 1.85 | 1.48 | 1.44 | 1.91 |
| BDL197 | 11364.5 | P | | | 0.02 | 0.47 | | 0.11 | 0.04 |
| BDL197 | 11364.5 | Av | | | 1.37 | 1.16 | | 1.18 | 1.42 |
| BDL197 | 11363.1 | P | | | | | 0.1 | 0.53 | 0.17 |
| BDL197 | 11363.1 | Av | | | | | 1.12 | 1.1 | 1.23 |
| BDL197 | 11363.6 | P | 0.11 | 0.03 | 0.01 | <0.01 | <0.01 | 0.06 | 0.04 |
| BDL197 | 11363.6 | Av | 1.39 | 1.49 | 1.3 | 1.58 | 1.24 | 1.45 | 1.55 |
| BDL197 | 11364.1 | P | 0.3 | | | 0.53 | | 0.62 | 0.07 |
| BDL197 | 11364.1 | Av | 1.18 | | | 1.11 | | 1.16 | 1.75 |
| BDL197 | 11364.5 | P | | | | | 0.12 | | 0.49 |
| BDL197 | 11364.5 | Av | | | | | 1.12 | | 1.13 |
| BDL201 | 9961.2 | P | | | 0.47 | | | 0.57 | 0.47 |
| BDL201 | 9961.2 | Av | | | 1.13 | | | 1.1 | 1.15 |
| BDL201 | 9961.3 | P | | | | | | 0.13 | |
| BDL201 | 9961.3 | Av | | | | | | 1.39 | |
| BDL201 | 9961.4 | P | 0.19 | 0.41 | | | | | |
| BDL201 | 9961.4 | Av | 1.3 | 1.14 | | | | | |
| BDL201 | 9964.3 | P | 0.17 | 0.05 | | 0.27 | | | |
| BDL201 | 9964.3 | Av | 1.25 | 1.21 | | 1.15 | | | |
| BDL203 | 9831.14 | P | | | | | | 0.62 | 0.42 |
| BDL203 | 9831.14 | Av | | | | | | 1.13 | 1.27 |

TABLE 22-continued

Results obtained in a tissue culture assay

| Gene | Ev. | Par. | Roots Coverage TP2 | Roots Coverage TP3 | RGR Of Leaf Area | RGR Of Root Coverage | RGR Of Roots Length | Fresh Weight | Dry Weight |
|---|---|---|---|---|---|---|---|---|---|
| BDL203 | 9831.7 | P | | | | | 0.11 | | |
| BDL203 | 9831.7 | Av | | | | | 1.22 | | |
| BDL203 | 9833.6 | P | | | | | 0.71 | | |
| BDL203 | 9833.6 | Av | | | | | 1.14 | | |
| BDL203 | 9835.2 | P | | | | | 0.33 | | |
| BDL203 | 9835.2 | Av | | | | | 1.14 | | |
| BDL220 | 10331.2 | P | | | | | | <0.01 | 0.06 |
| BDL220 | 10331.2 | Av | | | | | | 1.51 | 1.25 |
| BDL220 | 10331.5 | P | | 0.22 | <0.01 | 0.1 | 0.27 | 0.05 | 0.11 |
| BDL220 | 10331.5 | Av | | 1.22 | 1.81 | 1.28 | 1.11 | 1.97 | 1.6 |
| BDL220 | 10333.5 | P | | | | | | 0.47 | 0.41 |
| BDL220 | 10333.5 | Av | | | | | | 1.16 | 1.18 |
| BDL220 | 10334.2 | P | | | 0.34 | | | 0.35 | |
| BDL220 | 10334.2 | Av | | | 1.13 | | | 1.14 | |
| BDL221 | 10341.1 | P | | | | | | 0.19 | |
| BDL221 | 10341.1 | Av | | | | | | 1.3 | |
| BDL221 | 10341.3 | P | | | 0.01 | | | 0.01 | <0.01 |
| BDL221 | 10341.3 | Av | | | 1.5 | | | 1.92 | 2.18 |
| BDL221 | 10341.4 | P | | | 0.02 | | | <0.01 | 0.01 |
| BDL221 | 10341.4 | Av | | | 1.29 | | | 1.98 | 2.04 |
| BDL221 | 10343.3 | P | 0.03 | 0.01 | 0.07 | <0.01 | <0.01 | | |
| BDL221 | 10343.3 | Av | 1.55 | 1.6 | 1.21 | 1.6 | 1.41 | | |
| BDL221 | 10344.3 | P | | | | | | 0.41 | |
| BDL221 | 10344.3 | Av | | | | | | 1.11 | |
| BDL221 | 10341.1 | P | | | 0.15 | | | | 0.59 |
| BDL221 | 10341.1 | Av | | | 1.27 | | | | 1.16 |
| BDL221 | 10342.1 | P | <0.01 | <0.01 | 0.17 | <0.01 | <0.01 | 0.25 | 0.42 |
| BDL221 | 10342.1 | Av | 3.03 | 2.06 | 1.22 | 1.88 | 1.52 | 1.24 | 1.24 |
| BDL221 | 10343.1 | P | 0.01 | <0.01 | 0.01 | <0.01 | <0.01 | 0.15 | 0.33 |
| BDL221 | 10343.1 | Av | 1.8 | 1.61 | 1.62 | 1.6 | 1.41 | 1.46 | 1.51 |
| BDL221 | 10343.3 | P | 0.01 | 0.02 | 0.03 | <0.01 | <0.01 | | |
| BDL221 | 10343.3 | Av | 3.03 | 2.69 | 1.4 | 2.71 | 1.92 | | |
| BDL221 | 10343.4 | P | 0.03 | 0.08 | 0.07 | <0.01 | 0.01 | 0.14 | 0.08 |
| BDL221 | 10343.4 | Av | 2.15 | 2.07 | 1.51 | 2.07 | 1.49 | 1.44 | 1.53 |
| BDL221 | 10344.3 | P | 0.01 | 0.07 | 0.02 | 0.02 | 0.09 | 0.17 | 0.12 |
| BDL221 | 10344.3 | Av | 1.67 | 1.49 | 1.49 | 1.48 | 1.23 | 1.39 | 1.33 |
| BDL223 | 10791.1 | P | | | | | 0.33 | | |
| BDL223 | 10791.1 | Av | | | | | 1.13 | | |
| BDL223 | 10793.5 | P | 0.1 | 0.01 | | 0.01 | 0.02 | | |
| BDL223 | 10793.5 | Av | 1.21 | 1.32 | | 1.38 | 1.33 | | |
| BDL223 | 10793.8 | P | | | | | 0.21 | | |
| BDL223 | 10793.8 | Av | | | | | 1.18 | | |
| BDL223 | 10796.1 | P | | | | 0.58 | 0.41 | | |
| BDL223 | 10796.1 | Av | | | | 1.1 | 1.12 | | |
| BDL223 | 10796.2 | P | 0.41 | | | | 0.33 | 0.34 | 0.16 |
| BDL223 | 10796.2 | Av | 1.11 | | | | 1.13 | 1.14 | 1.4 |
| BDL223 | 10791.1 | P | | 0.03 | 0.02 | 0.05 | 0.06 | | 0.3 |
| BDL223 | 10791.1 | Av | | 1.38 | 1.34 | 1.43 | 1.3 | | 1.24 |
| BDL223 | 10793.3 | P | | 0.34 | <0.01 | 0.08 | 0.01 | 0.24 | 0.16 |
| BDL223 | 10793.3 | Av | | 1.45 | 1.64 | 1.62 | 1.48 | 1.15 | 1.39 |
| BDL223 | 10793.5 | P | 0.47 | 0.23 | 0.44 | 0.15 | 0.04 | | |
| BDL223 | 10793.5 | Av | 1.13 | 1.29 | 1.11 | 1.34 | 1.31 | | |
| BDL223 | 10793.8 | P | <0.01 | <0.01 | 0.07 | <0.01 | <0.01 | | 0.21 |
| BDL223 | 10793.8 | Av | 1.75 | 1.71 | 1.26 | 1.72 | 1.47 | | 1.26 |
| BDL223 | 10796.1 | P | | 0.01 | 0.03 | 0.01 | 0.07 | | 0.3 |
| BDL223 | 10796.1 | Av | | 1.47 | 1.31 | 1.61 | 1.29 | | 1.2 |
| BDL224 | 10451.5 | P | | | 0.17 | | | 0.21 | 0.2 |
| BDL224 | 10451.5 | Av | | | 1.19 | | | 1.28 | 1.25 |
| BDL224 | 10451.7 | P | 0.11 | 0.16 | <0.01 | 0.01 | 0.35 | 0.11 | 0.19 |
| BDL224 | 10451.7 | Av | 1.48 | 1.67 | 1.85 | 1.69 | 1.13 | 1.48 | 1.29 |
| BDL224 | 10451.8 | P | | | | 0.5 | | | |
| BDL224 | 10451.8 | Av | | | | 1.13 | | | |
| BDL226 | 10861.2 | P | | 0.41 | 0.41 | 0.15 | 0.08 | | |
| BDL226 | 10861.2 | Av | | 1.18 | 1.1 | 1.26 | 1.26 | | |
| BDL226 | 10861.4 | P | | 0.18 | | 0.03 | 0.04 | | 0.23 |
| BDL226 | 10861.4 | Av | | 1.27 | | 1.37 | 1.28 | | 1.2 |
| BDL226 | 10862.2 | P | | 0.56 | | 0.23 | 0.19 | | |
| BDL226 | 10862.2 | Av | | 1.11 | | 1.2 | 1.18 | | |
| BDL227 | 11491.1 | P | <0.01 | 0.12 | | 0.25 | | | |
| BDL227 | 11491.1 | Av | 1.59 | 1.25 | | 1.2 | | | |
| BDL227 | 11491.3 | P | 0.01 | 0.05 | 0.06 | <0.01 | <0.01 | 0.42 | 0.35 |
| BDL227 | 11491.3 | Av | 1.87 | 1.71 | 1.29 | 1.66 | 1.52 | 1.12 | 1.23 |
| BDL227 | 11491.5 | P | 0.01 | 0.03 | 0.04 | <0.01 | <0.01 | 0.36 | 0.15 |

TABLE 22-continued

Results obtained in a tissue culture assay

| Gene | Ev. | Par. | Roots Coverage TP2 | Roots Coverage TP3 | RGR Of Leaf Area | RGR Of Root Coverage | RGR Of Roots Length | Fresh Weight | Dry Weight |
|---|---|---|---|---|---|---|---|---|---|
| BDL227 | 11491.5 | Av | 2.24 | 2 | 1.34 | 1.94 | 1.58 | 1.24 | 1.34 |
| BDL227 | 11492.5 | P | <0.01 | 0.03 | <0.01 | <0.01 | 0.02 | 0.13 | 0.12 |
| BDL227 | 11492.5 | Av | 2.09 | 1.71 | 1.64 | 1.72 | 1.39 | 2.07 | 1.86 |
| BDL227 | 11493.5 | P | <0.01 | 0.01 | <0.01 | <0.01 | <0.01 | 0.16 | 0.08 |
| BDL227 | 11493.5 | Av | 2.13 | 2.02 | 1.78 | 2.05 | 1.64 | 1.55 | 1.73 |
| BDL230 | 10671.3 | P | | | <0.01 | | | <0.01 | <0.01 |
| BDL230 | 10671.3 | Av | | | 1.95 | | | 1.84 | 2.02 |
| BDL231 | 11111.1 | P | 0.58 | 0.12 | <0.01 | 0.1 | 0.51 | 0.14 | 0.55 |
| BDL231 | 11111.1 | Av | 1.1 | 1.24 | 1.5 | 1.27 | 1.1 | 1.24 | 1.1 |
| BDL231 | 11111.2 | P | 0.24 | 0.09 | <0.01 | 0.09 | 0.16 | | |
| BDL231 | 11111.2 | Av | 1.18 | 1.24 | 1.31 | 1.27 | 1.2 | | |
| BDL231 | 11111.3 | P | 0.33 | 0.08 | <0.01 | 0.03 | | 0.31 | 0.35 |
| BDL231 | 11111.3 | Av | 1.13 | 1.36 | 1.38 | 1.39 | | 1.15 | 1.2 |
| BDL231 | 11112.2 | P | <0.01 | 0.01 | 0.01 | <0.01 | 0.05 | | 0.52 |
| BDL231 | 11112.2 | Av | 1.89 | 1.61 | 1.3 | 1.55 | 1.27 | | 1.21 |
| BDL231 | 11116.5 | P | <0.01 | <0.01 | <0.01 | <0.01 | 0.23 | 0.21 | 0.05 |
| BDL231 | 11116.5 | Av | 1.97 | 1.79 | 1.74 | 1.78 | 1.18 | 1.28 | 1.45 |
| BDL231 | 11111.1 | P | 0.09 | 0.31 | <0.01 | 0.38 | 0.51 | 0.1 | 0.16 |
| BDL231 | 11111.1 | Av | 1.25 | 1.18 | 1.41 | 1.16 | 1.1 | 1.23 | 1.2 |
| BDL231 | 11111.2 | P | 0.02 | 0.2 | 0.01 | 0.32 | | 0.07 | 0.28 |
| BDL231 | 11111.2 | Av | 1.31 | 1.19 | 1.4 | 1.17 | | 1.46 | 1.24 |
| BDL231 | 11112.2 | P | 0.1 | | | | | | |
| BDL231 | 11112.2 | Av | 1.42 | | | | | | |
| BDL232 | 10904.1 | P | 0.6 | 0.26 | 0.33 | 0.16 | 0.11 | 0.71 | 0.5 |
| BDL232 | 10904.1 | Av | 1.25 | 1.36 | 1.29 | 1.44 | 1.29 | 1.14 | 1.37 |
| BDL232 | 10905.1 | P | 0.27 | 0.24 | | 0.3 | | | |
| BDL232 | 10905.1 | Av | 1.18 | 1.26 | | 1.23 | | | |
| BDL232 | 10906.3 | P | 0.48 | 0.24 | 0.02 | 0.07 | 0.06 | 0.14 | 0.13 |
| BDL232 | 10906.3 | Av | 1.37 | 1.63 | 1.61 | 1.75 | 1.44 | 1.48 | 1.77 |
| BDL232 | 10902.2 | P | 0.02 | 0.22 | | 0.43 | | | |
| BDL232 | 10902.2 | Av | 1.65 | 1.24 | | 1.12 | | | |
| BDL232 | 10905.1 | P | 0.18 | | | | | | |
| BDL232 | 10905.1 | Av | 1.28 | | | | | | |
| BDL232 | 10906.4 | P | | | | | 0.06 | | |
| BDL232 | 10906.4 | Av | | | | | 1.15 | | |
| BDL233 | 10822.4 | P | | | | | 0.28 | | |
| BDL233 | 10822.4 | Av | | | | | 1.13 | | |
| BDL233 | 10824.2 | P | | | | | 0.05 | | |
| BDL233 | 10824.2 | Av | | | | | 1.25 | | |
| BDL233 | 10825.3 | P | | | | | 0.1 | | |
| BDL233 | 10825.3 | Av | | | | | 1.21 | | |
| BDL233 | 10825.4 | P | <0.01 | 0.01 | | <0.01 | 0.03 | | |
| BDL233 | 10825.4 | Av | 1.78 | 1.49 | | 1.43 | 1.29 | | |
| BDL233 | 10822.4 | P | | | 0.04 | | 0.19 | 0.26 | 0.37 |
| BDL233 | 10822.4 | Av | | | 1.37 | | 1.21 | 1.18 | 1.24 |
| BDL233 | 10824.1 | P | | | 0.43 | | 0.48 | | |
| BDL233 | 10824.1 | Av | | | 1.11 | | 1.1 | | |
| BDL233 | 10824.2 | P | | 0.38 | 0.3 | 0.19 | <0.01 | | |
| BDL233 | 10824.2 | Av | | 1.16 | 1.16 | 1.29 | 1.5 | | |
| BDL233 | 10825.4 | P | 0.22 | 0.02 | 0.18 | 0.04 | 0.01 | | 0.42 |
| BDL233 | 10825.4 | Av | 1.23 | 1.44 | 1.23 | 1.46 | 1.47 | | 1.14 |
| BDL235 | 11412.2 | P | | 0.34 | | 0.33 | 0.4 | | |
| BDL235 | 11412.2 | Av | | 1.14 | | 1.17 | 1.11 | | |
| BDL235 | 11413.2 | P | 0.07 | 0.06 | | 0.03 | | | |
| BDL235 | 11413.2 | Av | 1.43 | 1.39 | | 1.38 | | | |
| BDL235 | 11413.3 | P | | | | | | 0.51 | 0.3 |
| BDL235 | 11413.3 | Av | | | | | | 1.15 | 1.18 |
| BDL235 | 11411.2 | P | | | | | 0.08 | | 0.62 |
| BDL235 | 11411.2 | Av | | | | | 1.16 | | 1.15 |
| BDL235 | 11413.2 | P | <0.01 | 0.08 | | 0.12 | 0.15 | | |
| BDL235 | 11413.2 | Av | 1.61 | 1.33 | | 1.22 | 1.15 | | |
| BDL235 | 11413.3 | P | | | | | 0.09 | | |
| BDL235 | 11413.3 | Av | | | | | 1.16 | | |
| BDL237 | 10892.1 | P | | | | | 0.05 | | 0.14 |
| BDL237 | 10892.1 | Av | | | | | 1.43 | | 1.33 |
| BDL237 | 10892.2 | P | 0.18 | 0.19 | | 0.4 | 0.18 | | |
| BDL237 | 10892.2 | Av | 1.23 | 1.16 | | 1.14 | 1.18 | | |
| BDL237 | 10893.1 | P | 0.23 | 0.29 | 0.51 | 0.28 | 0.09 | | |
| BDL237 | 10893.1 | Av | 1.2 | 1.17 | 1.11 | 1.19 | 1.25 | | |
| BDL237 | 10895.3 | P | 0.01 | 0.01 | <0.01 | <0.01 | <0.01 | 0.09 | 0.05 |
| BDL237 | 10895.3 | Av | 2.68 | 2.3 | 1.85 | 2.32 | 1.77 | 1.59 | 1.71 |
| BDL237 | 10896.1 | P | | 0.71 | | 0.57 | 0.27 | | |
| BDL237 | 10896.1 | Av | | 1.11 | | 1.13 | 1.21 | | |

TABLE 22-continued

Results obtained in a tissue culture assay

| Gene | Ev. | Par. | Roots Coverage TP2 | Roots Coverage TP3 | RGR Of Leaf Area | RGR Of Root Coverage | RGR Of Roots Length | Fresh Weight | Dry Weight |
|---|---|---|---|---|---|---|---|---|---|
| BDL238 | 10951.4 | P | 0.51 | | | | | | |
| BDL238 | 10951.4 | Av | 1.13 | | | | | | |
| BDL238 | 10952.3 | P | 0.12 | 0.12 | | 0.25 | 0.09 | | |
| BDL238 | 10952.3 | Av | 1.3 | 1.29 | | 1.25 | 1.32 | | |
| BDL238 | 10953.1 | P | | | 0.37 | | 0.37 | | |
| BDL238 | 10953.1 | Av | | | 1.14 | | 1.15 | | |
| BDL238 | 10954.2 | P | | 0.52 | | 0.61 | 0.5 | | |
| BDL238 | 10954.2 | Av | | 1.13 | | 1.11 | 1.12 | | |
| BDL238 | 10954.3 | P | | | | | | | 0.67 |
| BDL238 | 10954.3 | Av | | | | | | | 1.12 |
| BDL240 | 10802.2 | P | | | | | 0.47 | | |
| BDL240 | 10802.2 | Av | | | | | 1.1 | | |
| BDL240 | 10806.6 | P | 0.33 | 0.43 | | 0.27 | 0.19 | | |
| BDL240 | 10806.6 | Av | 1.28 | 1.19 | | 1.2 | 1.18 | | |
| BDL240 | 10802.2 | P | 0.38 | | | | 0.1 | | |
| BDL240 | 10802.2 | Av | 1.17 | | | | 1.24 | | |
| BDL240 | 10803.5 | P | | | 0.48 | | 0.17 | | |
| BDL240 | 10803.5 | Av | | | 1.12 | | 1.18 | | |
| BDL240 | 10806.6 | P | 0.01 | 0.03 | 0.05 | <0.01 | 0.01 | 0.15 | 0.26 |
| BDL240 | 10806.6 | Av | 2.85 | 2.11 | 1.38 | 1.97 | 1.44 | 1.32 | 1.34 |
| BDL241 | 10875.1 | P | 0.1 | | | | 0.46 | | |
| BDL241 | 10875.1 | Av | 1.25 | | | | 1.13 | | |
| BDL241 | 10873.1 | P | | | | | 0.22 | | 0.61 |
| BDL241 | 10873.1 | Av | | | | | 1.19 | | 1.11 |
| BDL241 | 10874.2 | P | | | | | 0.45 | | |
| BDL241 | 10874.2 | Av | | | | | 1.11 | | |
| BDL241 | 10874.3 | P | 0.54 | 0.05 | 0.01 | 0.03 | 0.05 | 0.08 | 0.01 |
| BDL241 | 10874.3 | Av | 1.1 | 1.43 | 1.47 | 1.53 | 1.32 | 1.21 | 1.55 |
| BDL241 | 10875.1 | P | 0.09 | 0.53 | | | | | |
| BDL241 | 10875.1 | Av | 1.36 | 1.13 | | | | | |
| BDL242 | 10731.3 | P | <0.01 | 0.2 | | 0.19 | 0.12 | | 0.2 |
| BDL242 | 10731.3 | Av | 1.38 | 1.21 | | 1.19 | 1.21 | | 1.22 |
| BDL242 | 10731.5 | P | 0.1 | 0.31 | | 0.32 | | | |
| BDL242 | 10731.5 | Av | 1.34 | 1.16 | | 1.15 | | | |
| BDL242 | 10737.1 | P | | | | | 0.32 | | |
| BDL242 | 10737.1 | Av | | | | | 1.14 | | |
| BDL242 | 10731.3 | P | <0.01 | 0.01 | <0.01 | <0.01 | <0.01 | 0.05 | 0.04 |
| BDL242 | 10731.3 | Av | 1.75 | 1.62 | 2.15 | 1.62 | 1.39 | 2.12 | 2.23 |
| BDL242 | 10731.5 | P | 0.06 | | | | | | |
| BDL242 | 10731.5 | Av | 1.29 | | | | | | |
| BDL242 | 10731.7 | P | <0.01 | <0.01 | 0.01 | 0.01 | 0.03 | 0.01 | 0.04 |
| BDL242 | 10731.7 | Av | 1.85 | 1.49 | 1.45 | 1.47 | 1.28 | 1.64 | 1.86 |
| BDL242 | 10737.2 | P | 0.47 | 0.23 | <0.01 | 0.07 | 0.05 | <0.01 | 0.01 |
| BDL242 | 10737.2 | Av | 1.26 | 1.38 | 1.86 | 1.43 | 1.32 | 1.91 | 2.05 |
| BDL245 | 10811.2 | P | 0.54 | 0.17 | | 0.08 | 0.21 | | 0.3 |
| BDL245 | 10811.2 | Av | 1.1 | 1.22 | | 1.28 | 1.16 | | 1.14 |
| BDL245 | 10813.3 | P | | | | | 0.09 | | |
| BDL245 | 10813.3 | Av | | | | | 1.22 | | |
| BDL245 | 10816.3 | P | | | | | 0.14 | | |
| BDL245 | 10816.3 | Av | | | | | 1.18 | | |
| BDL247 | 10912.1 | P | | 0.08 | | 0.02 | 0.01 | | |
| BDL247 | 10912.1 | Av | | 1.31 | | 1.4 | 1.37 | | |
| BDL247 | 10912.2 | P | | | | | 0.08 | | |
| BDL247 | 10912.2 | Av | | | | | 1.22 | | |
| BDL247 | 10915.1 | P | | 0.45 | 0.22 | 0.14 | 0.02 | | 0.53 |
| BDL247 | 10915.1 | Av | | 1.19 | 1.2 | 1.28 | 1.4 | | 1.12 |
| BDL247 | 10911.1 | P | 0.15 | 0.1 | 0.01 | 0.01 | 0.02 | 0.3 | 0.23 |
| BDL247 | 10911.1 | Av | 1.96 | 1.8 | 1.6 | 1.79 | 1.45 | 1.38 | 1.5 |
| BDL247 | 10912.1 | P | 0.32 | 0.4 | 0.24 | 0.25 | 0.13 | 0.32 | 0.14 |
| BDL247 | 10912.1 | Av | 1.15 | 1.22 | 1.2 | 1.24 | 1.21 | 1.27 | 1.56 |
| BDL247 | 10912.2 | P | 0.04 | 0.01 | 0.03 | <0.01 | <0.01 | 0.09 | 0.3 |
| BDL247 | 10912.2 | Av | 1.73 | 1.74 | 1.36 | 1.81 | 1.62 | 1.41 | 1.35 |
| BDL247 | 10912.6 | P | | 0.61 | | 0.57 | 0.39 | 0.21 | 0.48 |
| BDL247 | 10912.6 | Av | | 1.11 | | 1.11 | 1.13 | 1.37 | 1.3 |
| BDL247 | 10915.1 | P | 0.23 | 0.14 | <0.01 | 0.03 | 0.08 | 0.02 | 0.06 |
| BDL247 | 10915.1 | Av | 1.47 | 1.52 | 1.81 | 1.54 | 1.3 | 1.74 | 1.58 |
| BDL248 | 11051.2 | P | <0.01 | 0.01 | 0.03 | 0.02 | <0.01 | 0.21 | |
| BDL248 | 11051.2 | Av | 1.61 | 1.45 | 1.36 | 1.43 | 1.42 | 1.22 | |
| BDL248 | 11052.2 | P | <0.01 | <0.01 | <0.01 | <0.01 | <0.01 | 0.04 | 0.01 |
| BDL248 | 11052.2 | Av | 1.89 | 1.68 | 1.89 | 1.7 | 1.44 | 1.74 | 1.81 |
| BDL248 | 11053.3 | P | <0.01 | <0.01 | 0.07 | <0.01 | 0.03 | 0.46 | 0.65 |
| BDL248 | 11053.3 | Av | 2.04 | 1.62 | 1.29 | 1.57 | 1.34 | 1.13 | 1.14 |
| BDL248 | 11054.3 | P | 0.15 | 0.15 | | 0.24 | 0.04 | | |

TABLE 22-continued

Results obtained in a tissue culture assay

| Gene | Ev. | Par. | Roots Coverage TP2 | Roots Coverage TP3 | RGR Of Leaf Area | RGR Of Root Coverage | RGR Of Roots Length | Fresh Weight | Dry Weight |
|---|---|---|---|---|---|---|---|---|---|
| BDL248 | 11054.3 | Av | 1.18 | 1.18 |  | 1.19 | 1.29 |  |  |
| BDL248 | 11051.2 | P |  |  |  |  | 0.18 |  |  |
| BDL248 | 11051.2 | Av |  |  |  |  | 1.1 |  |  |
| BDL248 | 11054.2 | P |  |  |  |  | 0.18 |  |  |
| BDL248 | 11054.2 | Av |  |  |  |  | 1.1 |  |  |
| BDL249 | 11401.2 | P | <0.01 | <0.01 | <0.01 | <0.01 | <0.01 | <0.01 | <0.01 |
| BDL249 | 11401.2 | Av | 3.19 | 2.43 | 2.68 | 2.35 | 1.67 | 2.55 | 3.02 |
| BDL249 | 11401.5 | P | <0.01 | 0.01 | 0.02 | <0.01 | 0.02 | 0.39 | 0.44 |
| BDL249 | 11401.5 | Av | 2.63 | 1.94 | 1.4 | 1.83 | 1.3 | 1.19 | 1.23 |
| BDL249 | 11402.4 | P | <0.01 | <0.01 | 0.03 | <0.01 | <0.01 | 0.03 | 0.1 |
| BDL249 | 11402.4 | Av | 2.42 | 1.99 | 1.38 | 2.02 | 1.65 | 1.37 | 1.43 |
| BDL249 | 11403.2 | P |  | 0.46 | 0.34 | 0.27 | 0.2 | 0.56 |  |
| BDL249 | 11403.2 | Av |  | 1.22 | 1.17 | 1.25 | 1.21 | 1.11 |  |
| BDL249 | 11404.3 | P | 0.01 | 0.07 |  | 0.23 | 0.22 |  |  |
| BDL249 | 11404.3 | Av | 1.43 | 1.22 |  | 1.19 | 1.19 |  |  |
| BDL249 | 11401.5 | P |  | 0.31 |  | 0.45 |  |  |  |
| BDL249 | 11401.5 | Av |  | 1.1 |  | 1.11 |  |  |  |
| BDL249 | 11404.3 | P | 0.03 | 0.22 |  | 0.2 | 0.04 |  |  |
| BDL249 | 11404.3 | Av | 1.33 | 1.18 |  | 1.18 | 1.23 |  |  |
| BDL250 | 10842.3 | P | <0.01 | 0.01 | 0.21 | <0.01 | 0.02 |  | 0.34 |
| BDL250 | 10842.3 | Av | 1.69 | 1.54 | 1.15 | 1.56 | 1.29 |  | 1.24 |
| BDL250 | 10846.2 | P | 0.01 | <0.01 | 0.29 | <0.01 | 0.05 | 0.4 | 0.21 |
| BDL250 | 10846.2 | Av | 1.43 | 1.41 | 1.12 | 1.45 | 1.25 | 1.19 | 1.33 |
| BDL250 | 10846.3 | P | 0.02 | 0.36 |  |  | 0.05 |  |  |
| BDL250 | 10846.3 | Av | 1.37 | 1.11 |  |  | 1.26 |  |  |
| BDL250 | 10841.3 | P | 0.01 | 0.02 | 0.17 | <0.01 | <0.01 |  |  |
| BDL250 | 10841.3 | Av | 1.99 | 1.66 | 1.22 | 1.61 | 1.62 |  |  |
| BDL250 | 10842.3 | P | 0.23 | 0.52 | 0.12 | 0.44 |  | 0.41 | 0.59 |
| BDL250 | 10842.3 | Av | 1.57 | 1.28 | 1.45 | 1.22 |  | 1.6 | 1.27 |
| BDL250 | 10843.2 | P | 0.03 | 0.07 | 0.01 | 0.01 | 0.01 | 0.02 | 0.1 |
| BDL250 | 10843.2 | Av | 1.85 | 1.67 | 1.55 | 1.62 | 1.37 | 1.53 | 1.6 |
| BDL250 | 10846.2 | P | 0.04 | <0.01 | <0.01 | <0.01 | <0.01 | 0.45 | 0.67 |
| BDL250 | 10846.2 | Av | 1.46 | 1.68 | 1.58 | 1.7 | 1.43 | 1.22 | 1.15 |
| BDL250 | 10846.3 | P | <0.01 | <0.01 | <0.01 | <0.01 | <0.01 | 0.05 | 0.03 |
| BDL250 | 10846.3 | Av | 2.79 | 2.32 | 1.76 | 2.28 | 1.84 | 1.8 | 1.87 |
| BDL252 | 10881.1 | P | 0.01 | <0.01 | <0.01 | <0.01 | <0.01 | 0.09 | 0.19 |
| BDL252 | 10881.1 | Av | 2.1 | 1.87 | 1.68 | 1.9 | 1.48 | 1.43 | 1.68 |
| BDL252 | 10882.1 | P | 0.01 | 0.01 | <0.01 | <0.01 | <0.01 | 0.18 | 0.18 |
| BDL252 | 10882.1 | Av | 3.11 | 2.51 | 1.97 | 2.43 | 1.82 | 1.4 | 1.51 |
| BDL252 | 10882.2 | P | 0.05 | <0.01 | 0.04 | <0.01 | 0.01 |  | 0.62 |
| BDL252 | 10882.2 | Av | 1.87 | 1.74 | 1.35 | 1.72 | 1.44 |  | 1.11 |
| BDL252 | 10882.4 | P | 0.01 | 0.01 | 0.17 | 0.01 | 0.38 |  |  |
| BDL252 | 10882.4 | Av | 2.06 | 1.62 | 1.24 | 1.52 | 1.13 |  |  |
| BDL252 | 10884.1 | P |  |  | 0.5 |  |  | 0.24 | 0.24 |
| BDL252 | 10884.1 | Av |  |  | 1.1 |  |  | 1.22 | 1.3 |
| BDL58 | 10281.5 | P |  |  | 0.07 | 0.46 | 0.15 | 0.55 | 0.02 |
| BDL58 | 10281.5 | Av |  |  | 1.32 | 1.15 | 1.18 | 1.14 | 1.37 |
| BDL58 | 10282.3 | P | <0.01 | 0.01 | <0.01 | <0.01 | <0.01 | <0.01 | <0.01 |
| BDL58 | 10282.3 | Av | 1.94 | 2.18 | 1.77 | 2.29 | 1.81 | 1.79 | 1.83 |
| BDL58 | 10285.3 | P |  |  |  |  | 0.06 |  |  |
| BDL58 | 10285.3 | Av |  |  |  |  | 1.21 |  |  |
| BDL62 | 10682.1 | P |  | 0.31 | 0.43 | 0.12 |  |  | 0.4 |
| BDL62 | 10682.1 | Av |  | 1.35 | 1.19 | 1.46 |  |  | 1.33 |
| BDL62 | 10684.2 | P |  | 0.43 |  | 0.33 | 0.08 |  | 0.58 |
| BDL62 | 10684.2 | Av |  | 1.17 |  | 1.23 | 1.26 |  | 1.11 |
| BDL62 | 10684.5 | P |  |  | 0.41 | 0.64 | 0.31 | 0.67 | 0.64 |
| BDL62 | 10684.5 | Av |  |  | 1.14 | 1.11 | 1.15 | 1.13 | 1.13 |
| BDL64 | 10651.5 | P |  |  | 0.02 | 0.39 | 0.07 | 0.17 | 0.26 |
| BDL64 | 10651.5 | Av |  |  | 1.77 | 1.14 | 1.19 | 1.54 | 1.52 |
| BDL64 | 10653.1 | P |  | 0.14 | <0.01 | 0.13 |  | <0.01 | 0.03 |
| BDL64 | 10653.1 | Av |  | 1.21 | 1.62 | 1.24 |  | 1.42 | 1.51 |
| BDL64 | 10653.3 | P |  |  |  |  | 0.01 |  |  |
| BDL64 | 10653.3 | Av |  |  |  |  | 1.25 |  |  |
| BDL64 | 10654.3 | P | 0.15 | 0.23 | 0.06 | 0.02 | <0.01 | 0.37 | 0.27 |
| BDL64 | 10654.3 | Av | 1.53 | 1.6 | 1.5 | 1.71 | 1.55 | 1.45 | 1.44 |
| BDL64 | 10651.1 | P |  |  | 0.5 |  |  | 0.31 | 0.16 |
| BDL64 | 10651.1 | Av |  |  | 1.13 |  |  | 1.45 | 1.91 |
| BDL64 | 10651.2 | P |  |  |  |  |  |  | 0.62 |
| BDL64 | 10651.2 | Av |  |  |  |  |  |  | 1.13 |
| BDL64 | 10651.5 | P |  |  |  |  |  |  | 0.48 |
| BDL64 | 10651.5 | Av |  |  |  |  |  |  | 1.15 |
| BDL64 | 10653.1 | P | 0.01 | 0.02 | 0.01 | <0.01 | 0.02 | 0.05 | 0.03 |
| BDL64 | 10653.1 | Av | 2.18 | 2.28 | 1.69 | 2.43 | 1.25 | 2.27 | 3.13 |

TABLE 22-continued

Results obtained in a tissue culture assay

| Gene | Ev. | Par. | Roots Coverage TP2 | Roots Coverage TP3 | RGR Of Leaf Area | RGR Of Root Coverage | RGR Of Roots Length | Fresh Weight | Dry Weight |
|---|---|---|---|---|---|---|---|---|---|
| BDL64 | 10654.3 | P | <0.01 | <0.01 | 0.02 | <0.01 | 0.03 | 0.01 | <0.01 |
| BDL64 | 10654.3 | Av | 1.78 | 1.9 | 1.46 | 1.97 | 1.2 | 1.7 | 2.53 |
| BDL64 | 10651.1 | P | 0.11 | | | | | | |
| BDL64 | 10651.1 | Av | 1.27 | | | | | | |
| BDL64 | 10651.3 | P | 0.14 | 0.32 | | 0.46 | | | |
| BDL64 | 10651.3 | Av | 1.43 | 1.22 | | 1.14 | | | |
| BDL79 | 11042.3 | P | | | | | 0.5 | | |
| BDL79 | 11042.3 | Av | | | | | 1.1 | | |
| BDL79 | 11042.3 | P | | 0.44 | | 0.28 | 0.04 | | |
| BDL79 | 11042.3 | Av | | 1.18 | | 1.26 | 1.36 | | |
| BDL79 | 11042.7 | P | | | 0.4 | | | | 0.55 |
| BDL79 | 11042.7 | Av | | | 1.12 | | | | 1.11 |
| BDL79 | 11043.1 | P | | 0.27 | 0.03 | 0.25 | 0.03 | 0.29 | 0.22 |
| BDL79 | 11043.1 | Av | | 1.28 | 1.35 | 1.3 | 1.35 | 1.18 | 1.22 |
| BDL85 | 10411.1 | P | 0.74 | 0.55 | | 0.42 | | | |
| BDL85 | 10411.1 | Av | 1.1 | 1.14 | | 1.16 | | | |
| BDL85 | 10411.3 | P | 0.14 | 0.01 | | 0.03 | 0.17 | | |
| BDL85 | 10411.3 | Av | 1.24 | 1.28 | | 1.32 | 1.13 | | |
| BDL85 | 10412.2 | P | | | 0.44 | | | 0.06 | 0.15 |
| BDL85 | 10412.2 | Av | | | 1.1 | | | 1.22 | 1.24 |
| BDL85 | 10414.1 | P | | 0.01 | 0.05 | 0.02 | 0.08 | 0.38 | 0.47 |
| BDL85 | 10414.1 | Av | | 1.3 | 1.29 | 1.39 | 1.18 | 1.17 | 1.11 |
| BDL85 | 10414.2 | P | | 0.27 | <0.01 | 0.07 | 0.07 | <0.01 | 0.08 |
| BDL85 | 10414.2 | Av | | 1.15 | 1.42 | 1.28 | 1.17 | 1.55 | 1.5 |
| BDL88 | 10291.2 | P | 0.31 | 0.15 | 0.02 | 0.08 | 0.08 | 0.06 | 0.11 |
| BDL88 | 10291.2 | Av | 1.26 | 1.33 | 1.45 | 1.36 | 1.24 | 1.35 | 1.36 |
| BDL88 | 10291.4 | P | 0.01 | 0.02 | <0.01 | <0.01 | <0.01 | 0.23 | 0.25 |
| BDL88 | 10291.4 | Av | 1.72 | 1.57 | 1.54 | 1.62 | 1.42 | 1.44 | 1.35 |
| BDL88 | 10291.5 | P | 0.59 | 0.44 | 0.48 | 0.38 | | | |
| BDL88 | 10291.5 | Av | 1.13 | 1.17 | 1.13 | 1.17 | | | |
| BDL88 | 10293.3 | P | 0.14 | 0.28 | <0.01 | 0.11 | 0.26 | 0.16 | 0.08 |
| BDL88 | 10293.3 | Av | 1.34 | 1.35 | 2.15 | 1.36 | 1.19 | 1.58 | 1.97 |
| BDL88 | 10291.2 | P | 0.16 | 0.05 | <0.01 | 0.01 | 0.21 | 0.33 | 0.47 |
| BDL88 | 10291.2 | Av | 1.32 | 1.45 | 1.56 | 1.48 | 1.18 | 1.17 | 1.16 |
| BDL88 | 10291.4 | P | | | <0.01 | | | | |
| BDL88 | 10291.4 | Av | | | 1.49 | | | | |
| BDL88 | 10291.5 | P | | | <0.01 | | | 0.15 | 0.38 |
| BDL88 | 10291.5 | Av | | | 1.84 | | | 1.25 | 1.22 |
| BDL88 | 10293.3 | P | | | 0.02 | | | | 0.47 |
| BDL88 | 10293.3 | Av | | | 1.23 | | | | 1.15 |
| BDL88 | 10294.2 | P | | | <0.01 | | | 0.3 | 0.55 |
| BDL88 | 10294.2 | Av | | | 1.76 | | | 1.23 | 1.16 |
| BDL90 | 10921.3 | P | | | | | 0.22 | | |
| BDL90 | 10921.3 | Av | | | | | 1.18 | | |
| BDL90 | 10921.6 | P | | | | | 0.09 | | |
| BDL90 | 10921.6 | Av | | | | | 1.28 | | |
| BDL90 | 10924.2 | P | 0.06 | 0.04 | | <0.01 | <0.01 | | |
| BDL90 | 10924.2 | Av | 2 | 1.75 | | 1.73 | 1.5 | | |
| BDL90 | 10924.4 | P | | | | | 0.33 | | |
| BDL90 | 10924.4 | Av | | | | | 1.12 | | |
| BDL90 | 10925.4 | P | 0.02 | 0.03 | | <0.01 | <0.01 | | |
| BDL90 | 10925.4 | Av | 2.27 | 1.81 | | 1.76 | 1.46 | | |
| BDL90 | 10923.4 | P | | | | | 0.27 | | |
| BDL90 | 10923.4 | Av | | | | | 1.17 | | |
| BDL90 | 10924.2 | P | 0.06 | 0.28 | 0.22 | 0.33 | 0.06 | | |
| BDL90 | 10924.2 | Av | 1.43 | 1.26 | 1.19 | 1.22 | 1.3 | | |
| BDL90 | 10925.4 | P | 0.02 | 0.04 | | 0.03 | 0.01 | | |
| BDL90 | 10925.4 | Av | 1.7 | 1.58 | | 1.54 | 1.43 | | |
| BDL90 | 10921.6 | P | | 0.75 | 0.04 | 0.42 | 0.02 | | 0.13 |
| BDL90 | 10921.6 | Av | | 1.11 | 1.32 | 1.24 | 1.41 | | 1.28 |
| BDL90 | 10923.4 | P | | | | 0.51 | 0.12 | | 0.58 |
| BDL90 | 10923.4 | Av | | | | 1.15 | 1.25 | | 1.15 |
| BDL90 | 10924.2 | P | 0.16 | 0.01 | 0.28 | 0.01 | <0.01 | | |
| BDL90 | 10924.2 | Av | 1.4 | 1.65 | 1.18 | 1.7 | 1.54 | | |
| BDL90 | 10925.4 | P | <0.01 | <0.01 | <0.01 | <0.01 | <0.01 | 0.05 | 0.03 |
| BDL90 | 10925.4 | Av | 2.34 | 2.48 | 1.88 | 2.4 | 1.61 | 1.55 | 1.78 |
| BDL94 | 11721.4 | P | | | 0.45 | | | 0.09 | 0.26 |
| BDL94 | 11721.4 | Av | | | 1.11 | | | 1.29 | 1.16 |
| BDL94 | 11725.3 | P | | | | | | 0.17 | |
| BDL94 | 11725.3 | Av | | | | | | 1.2 | |

TABLE 22-continued

Results obtained in a tissue culture assay

| Gene | Ev. | Par. | Roots Coverage TP2 | Roots Coverage TP3 | RGR Of Leaf Area | RGR Of Root Coverage | RGR Of Roots Length | Fresh Weight | Dry Weight |
|---|---|---|---|---|---|---|---|---|---|
| BDL94 | 11725.3 | P | | | | | | 0.31 | |
| BDL94 | 11725.3 | Av | | | | | | 1.29 | |

Table 22.
"P" = P-value;
"Av" = ratio between the averages of event and control.
Note that when the average ratio is higher than "1" the effect of exogenous expression of the gene is an increase of the desired trait;
"Par" = Parameter according to the measured parameters;
"Ev" = event.
TP1 = Time point 1;
TP2 = Time point 2;
TP3 = Time point 3;
RGR = relative growth rate.

Greenhouse assays—Table 23 specifies the parameters that were measured in the greenhouse assays and which are presented in Tables 24, 25, 26 and 27. In cases where a certain event appears more than once, the event was tested in several independent experiments. The parameters were measured as follows:

The plants were analyzed for their overall size, growth rate, flowering, seed yield, weight of 1,000 seeds, dry matter and harvest index (HI-seed yield/dry matter). Transgenic plants performance was compared to control plants grown in parallel under the same conditions. Mock-transgenic plants expressing the uidA reporter gene (GUS-Intron) or with no gene at all, under the same promoter were used as control.

The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which included 4 light units (4×150 Watts light bulb) is used for capturing images of plant samples.

The image capturing process was repeated every 2 days starting from day 1 after transplanting till day 16. Same camera, placed in a custom made iron mount, was used for capturing images of larger plants sawn in white tubs in an environmental controlled greenhouse. The tubs were square shape include 1.7 liter trays. During the capture process, the tubs were placed beneath the iron mount, while avoiding direct sun light and casting of shadows.

An image analysis system was used, which consists of a personal desktop computer (Intel P4 3.0 GHz processor) and a public domain program—ImageJ 1.39 (Java based image processing program which was developed at the U.S National Institutes of Health and freely available on the internet at Hypertext Transfer Protocol://rsbweb (dot) nih (dot) gov/). Images were captured in resolution of 10 Mega Pixels (3888× 2592 pixels) and stored in a low compression JPEG (Joint Photographic Experts Group standard) format. Next, analyzed data was saved to text files and processed using the JMP statistical analysis software (SAS institute).

Leaf growth analysis—Using the digital analysis leaves data was calculated, including leaf number, rosette area, rosette diameter, leaf blade area, plot coverage, leaf petiole length.

The Vegetative Growth Rate of the Plant was Defined by Formulas IX, X, XI and XII.
Formula IX:
Relative growth rate of leaf blade area=Regression coefficient of leaf area along time course.
Formula X:
Relative growth rate of rosette area=Regression coefficient of rosette area along time course.
Formula XI
Relative growth rate of rosette diameter=Regression coefficient of rosette diameter along time course.
Formula XII
Relative growth rate of plot coverage=Regression coefficient of plot coverage along time course.
Seeds average weight (Seed weight or 1000 seed weight)—At the end of the experiment all seeds were collected. The seeds were scattered on a glass tray and a picture was taken. Using the digital analysis, the number of seeds in each sample was calculated.

Plant dry weight and seed yield—On about day 80 from sowing, the plants were harvested and left to dry at 30° C. in a drying chamber. The biomass and seed weight of each plot were measured and divided by the number of plants in each plot. Dry weight=total weight of the vegetative portion above ground (excluding roots) after drying at 30° C. in a drying chamber;
Seed yield per plant=total seed weight per plant (gr.).
1000 seed weight (the weight of 1000 seeds) (gr.).
The harvest index was calculated using Formula IV (Harvest Index=Average seed yield per plant/Average dry weight) as described above.

Oil percentage in seeds—At the end of the experiment all seeds from plots A-C were collected. Columbia seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingler's) 1879, 232, 461) was used to create a calibration curve for the Low Resonance NMR. The content of oil of all seed samples was determined using the Low Resonance NMR (MARAN Ultra-Oxford Instrument) and its MultiQuant sowftware package.

Oil yield—The oil yield was calculated using Formula VII (described above).

Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Statistical analyses—To identify genes conferring significantly improved tolerance to abiotic stresses, the results obtained from the transgenic plants were compared to those obtained from control plants. To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

TABLE 23

Parameters measured in greenhouse assays

| Parameter | Number |
|---|---|
| Rosette Diameter TP2 | 1 |
| Rosette Diameter TP3 | 2 |
| Rosette Diameter TP4 | 3 |
| Rosette Area TP2 | 4 |
| Rosette Area TP3 | 5 |
| Rosette Area TP4 | 6 |
| Plot Coverage TP2 | 7 |
| Plot Coverage TP3 | 8 |
| Plot Coverage TP4 | 9 |
| Leaf Number TP2 | 10 |
| Leaf Number TP3 | 11 |
| Leaf Number TP4 | 12 |
| Leaf Blade Area TP2 | 13 |
| Leaf Blade Area TP3 | 14 |
| Leaf Blade Area TP4 | 15 |
| Leaf Petiole Length TP2 | 16 |
| Leaf Petiole Length TP3 | 17 |
| Leaf Petiole Length TP4 | 18 |
| Blade Relative Area TP2 | 19 |
| Blade Relative Area TP3 | 20 |
| Blade Relative Area TP4 | 21 |
| Petiole Relative Area TP2 | 22 |
| Petiole Relative Area TP3 | 23 |
| Petiole Relative Area TP4 | 24 |
| RGR Of Leaf Blade Area | 25 |
| RGR Of Leaf Number | 26 |
| RGR Of Rosette Area | 27 |
| RGR Of Rosette Diameter | 28 |
| RGR Of Plot Coverage | 29 |
| Dry Weight | 30 |
| Fresh Weight | 31 |
| Inflorescence Emergence | 32 |
| Flowering | 33 |
| Seed Yield | 34 |
| Harvest Index | 35 |
| Seeds Weight | 36 |
| Oil Content | 37 |

Table 23. Provided are the parameters measured in greenhouse experiments which are presented in Tables 24-27 hereinbelow.
TP1 = Time point 1;
TP2 = Time point 2;
TP3 = Time point 3;
RGR = relative growth rate.

TABLE 24

Results from greenhouse experiments

| Gene | Ev. | Par: | 1 | 2 | 3 | 4 | 5 | 6 | 7 | 8 | 9 | 10 |
|---|---|---|---|---|---|---|---|---|---|---|---|---|
| BDL102 | 10471.1 | P | <0.01 | <0.01 | | 0.13 | 0.34 | 0.03 | 0.13 | 0.34 | 0.03 | |
| BDL102 | 10471.1 | Av | 1.24 | 1.14 | | 1.31 | 1.21 | 1.15 | 1.31 | 1.21 | 1.15 | |
| BDL102 | 10472.1 | P | 0.13 | 0.11 | 0.33 | 0.25 | 0.02 | 0.32 | 0.25 | 0.02 | 0.32 | |
| BDL102 | 10472.1 | Av | 1.26 | 1.19 | 1.14 | 1.37 | 1.26 | 1.26 | 1.37 | 1.26 | 1.26 | |
| BDL102 | 10474.1 | P | 0.22 | 0.23 | 0.26 | 0.19 | 0.2 | 0.23 | 0.19 | 0.2 | 0.23 | 0.19 |
| BDL102 | 10474.1 | Av | 1.35 | 1.33 | 1.2 | 1.65 | 1.87 | 1.49 | 1.65 | 1.87 | 1.49 | 1.1 |
| BDL102 | 10474.2 | P | 0.17 | 0.02 | 0.01 | 0.1 | 0.05 | <0.01 | 0.1 | 0.05 | <0.01 | <0.01 |
| BDL102 | 10474.2 | Av | 1.3 | 1.23 | 1.11 | 1.59 | 1.53 | 1.27 | 1.59 | 1.53 | 1.27 | 1.11 |
| BDL102 | 10474.6 | P | 0.02 | | | 0.23 | | | 0.23 | | | |
| BDL102 | 10474.6 | Av | 1.11 | | | 1.15 | | | 1.15 | | | |
| BDL117 | 10071.2 | P | | | | 0.62 | | | 0.59 | | | |
| BDL117 | 10071.2 | Av | | | | 1.14 | | | 1.16 | | | |
| BDL117 | 10074.1 | P | 0.28 | 0.22 | 0.16 | 0.29 | 0.3 | 0.3 | 0.28 | 0.29 | 0.29 | 0.34 |
| BDL117 | 10074.1 | Av | 1.26 | 1.23 | 1.24 | 1.58 | 1.47 | 1.44 | 1.6 | 1.49 | 1.46 | 1.15 |
| BDL117 | 10074.4 | P | 0.35 | 0.34 | 0.41 | 0.38 | 0.39 | 0.41 | 0.38 | 0.37 | 0.39 | 0.28 |
| BDL117 | 10074.4 | Av | 1.21 | 1.14 | 1.15 | 1.41 | 1.29 | 1.26 | 1.43 | 1.3 | 1.28 | 1.13 |
| BDL117 | 10073.1 | P | | | | 0.57 | 0.58 | 0.64 | | | | |
| BDL117 | 10073.1 | Av | | | | 1.13 | 1.17 | 1.14 | | | | |
| BDL117 | 10073.2 | P | | | 0.45 | 0.7 | 0.55 | 0.48 | 0.7 | 0.55 | 0.48 | |
| BDL117 | 10073.2 | Av | | | 1.14 | 1.1 | 1.21 | 1.22 | 1.1 | 1.21 | 1.22 | |
| BDL117 | 10074.1 | P | 0.41 | 0.4 | 0.39 | 0.44 | 0.37 | 0.38 | 0.44 | 0.37 | 0.38 | 0.13 |
| BDL117 | 10074.1 | Av | 1.1 | 1.15 | 1.15 | 1.17 | 1.32 | 1.29 | 1.17 | 1.32 | 1.29 | 1.15 |
| BDL117 | 10074.4 | P | | | | 0.1 | | 0.4 | 0.34 | | 0.4 | 0.34 |
| BDL117 | 10074.4 | Av | | | | 1.09 | | 1.1 | 1.13 | | 1.1 | 1.13 |
| BDL138 | 9812.1 | P | 0.04 | | | | | | | | | |
| BDL138 | 9812.1 | Av | 1.06 | | | | | | | | | |
| BDL138 | 9812.3 | P | | | | 0.06 | | | 0.04 | | | |
| BDL138 | 9812.3 | Av | | | | 1.18 | | | 1.19 | | | |
| BDL140 | 10423.1 | P | 0.02 | | | 0.01 | 0.22 | | 0.01 | 0.22 | | |
| BDL140 | 10423.1 | Av | 1.16 | | | 1.39 | 1.22 | | 1.39 | 1.22 | | |
| BDL140 | 10424.4 | P | | | | 0.62 | | | 0.62 | | | 0.1 |
| BDL140 | 10424.4 | Av | | | | 1.18 | | | 1.18 | | | 1.08 |
| BDL147 | 10301.5 | P | | | | | | | | | | 0.1 |
| BDL147 | 10301.5 | Av | | | | | | | | | | 1.08 |

TABLE 24-continued

| | | | \multicolumn{10}{c}{Results from greenhouse experiments} |
|---|---|---|---|---|---|---|---|---|---|---|---|---|
| Gene | Ev. | Par: | 1 | 2 | 3 | 4 | 5 | 6 | 7 | 8 | 9 | 10 |
| BDL147 | 10303.1 | P | <0.01 | 0.01 | | 0.06 | 0.04 | 0.08 | 0.06 | 0.04 | 0.08 | 0.05 |
| BDL147 | 10303.1 | Av | 1.23 | 1.21 | | 1.65 | 1.36 | 1.24 | 1.65 | 1.36 | 1.24 | 1.11 |
| BDL147 | 10303.6 | P | | | | 0.63 | 0.4 | | 0.63 | 0.4 | | |
| BDL147 | 10303.6 | Av | | | | 1.14 | 1.11 | | 1.14 | 1.11 | | |
| BDL147 | 10304.2 | P | | | | 0.33 | | | 0.33 | | | |
| BDL147 | 10304.2 | Av | | | | 1.19 | | | 1.19 | | | |
| BDL147 | 10304.2 | P | | | | | 0.44 | 0.36 | | 0.44 | 0.36 | |
| BDL147 | 10304.2 | Av | | | | | 1.17 | 1.11 | | 1.17 | 1.11 | |
| BDL149 | 9823.3 | P | 0.22 | 0.08 | | 0.33 | 0.13 | 0.29 | | 0.03 | | |
| BDL149 | 9823.3 | Av | 1.14 | 1.1 | | 1.14 | 1.18 | 1.14 | | 1.11 | | |
| BDL149 | 9824.4 | P | 0.01 | <0.01 | <0.01 | 0.08 | <0.01 | 0.04 | 0.09 | <0.01 | 0.04 | 0.03 |
| BDL149 | 9824.4 | Av | 1.16 | 1.13 | 1.13 | 1.35 | 1.26 | 1.29 | 1.37 | 1.28 | 1.31 | 1.05 |
| BDL149 | 9823.3 | P | | | | 0.65 | 0.67 | 0.63 | 0.65 | 0.67 | 0.63 | |
| BDL149 | 9823.3 | Av | | | | 1.17 | 1.1 | 1.13 | 1.17 | 1.1 | 1.13 | |
| BDL152 | 10431.1 | P | | | | 0.28 | | | 0.28 | | | |
| BDL152 | 10431.1 | Av | | | | 1.13 | | | 1.13 | | | |
| BDL152 | 10431.4 | P | | | | | 0.2 | 0.45 | | 0.2 | 0.45 | |
| BDL152 | 10431.4 | Av | | | | | 1.12 | 1.11 | | 1.12 | 1.11 | |
| BDL152 | 10434.4 | P | | | 0.22 | 0.72 | | 0.41 | 0.72 | | 0.41 | 0.09 |
| BDL152 | 10434.4 | Av | | | 1.12 | 1.12 | | 1.2 | 1.12 | | 1.2 | 1.07 |
| BDL153 | 10141.3 | P | <0.01 | <0.01 | <0.01 | 0.04 | <0.01 | <0.01 | 0.05 | <0.01 | <0.01 | <0.01 |
| BDL153 | 10141.3 | Av | 1.21 | 1.17 | 1.17 | 1.41 | 1.33 | 1.34 | 1.43 | 1.34 | 1.36 | |
| BDL153 | 10142.2 | P | 0.21 | 0.41 | 0.38 | 0.33 | 0.38 | 0.38 | 0.32 | 0.37 | 0.38 | 0.49 |
| BDL153 | 10142.2 | Av | 1.33 | 1.2 | 1.25 | 1.64 | 1.55 | 1.57 | 1.66 | 1.58 | 1.6 | 1.15 |
| BDL153 | 10143.1 | P | 0.03 | | | 0.14 | 0.07 | 0.37 | 0.14 | 0.04 | 0.34 | |
| BDL153 | 10143.1 | Av | 1.07 | | | 1.22 | 1.12 | 1.14 | 1.23 | 1.13 | 1.16 | |
| BDL153 | 10144.1 | P | | | | 0.08 | 0.08 | 0.1 | 0.03 | 0.03 | 0.04 | |
| BDL153 | 10144.1 | Av | | | | 1.11 | 1.1 | 1.11 | 1.13 | 1.11 | 1.13 | |
| BDL153 | 10141.3 | P | 0.1 | <0.01 | 0.01 | | | 0.01 | | | 0.01 | |
| BDL153 | 10141.3 | Av | 1.14 | 1.15 | 1.06 | | | 1.14 | | | 1.14 | |
| BDL153 | 10142.2 | P | 0.01 | 0.01 | 0.14 | 0.15 | 0.44 | 0.14 | 0.15 | 0.44 | 0.14 | |
| BDL153 | 10142.2 | Av | 1.17 | 1.16 | 1.16 | 1.18 | 1.19 | 1.31 | 1.18 | 1.19 | 1.31 | |
| BDL153 | 10142.3 | P | | | | | 0.4 | | | 0.4 | | |
| BDL153 | 10142.3 | Av | | | | | 1.15 | | | 1.15 | | |
| BDL153 | 10143.1 | P | | | | | | | | | | 0.38 |
| BDL153 | 10143.1 | Av | | | | | | | | | | 1.12 |
| BDL153 | 10143.2 | P | | | | | 0.25 | 0.11 | | 0.25 | 0.11 | |
| BDL153 | 10143.2 | Av | | | | | 1.11 | 1.12 | | 1.11 | 1.12 | |
| BDL153 | 10144.1 | P | | 0.3 | 0.17 | | 0.39 | 0.34 | | 0.39 | 0.34 | |
| BDL153 | 10144.1 | Av | | 1.23 | 1.1 | | 1.44 | 1.13 | | 1.44 | 1.13 | |
| BDL154 | 10703.8 | P | <0.01 | 0.03 | | 0.12 | 0.07 | 0.43 | 0.12 | 0.07 | 0.43 | |
| BDL154 | 10703.8 | Av | 1.29 | 1.2 | | 1.53 | 1.37 | 1.13 | 1.53 | 1.37 | 1.13 | |
| BDL155 | 9991.5 | P | 0.22 | 0.07 | 0.1 | 0.31 | | 0.31 | 0.31 | | 0.31 | 0.03 |
| BDL155 | 9991.5 | Av | 1.13 | 1.12 | 1.12 | 1.14 | | 1.12 | 1.14 | | 1.12 | 1.09 |
| BDL155 | 9994.3 | P | 0.17 | 0.02 | 0.08 | 0.16 | 0.06 | 0.17 | 0.16 | 0.06 | 0.17 | 0.09 |
| BDL155 | 9994.3 | Av | 1.15 | 1.17 | 1.12 | 1.17 | 1.27 | 1.21 | 1.17 | 1.27 | 1.21 | 1.07 |
| BDL162 | 10492.2 | P | | | 0.32 | 0.16 | 0.25 | 0.11 | 0.16 | 0.25 | 0.11 | 0.59 |
| BDL162 | 10492.2 | Av | | | 1.13 | 1.22 | 1.15 | 1.34 | 1.22 | 1.15 | 1.34 | 1.11 |
| BDL167 | 10044.2 | P | | | | | 0.17 | | | 0.6 | | |
| BDL167 | 10044.2 | Av | | | | | 1.17 | | | 1.1 | | |
| BDL167 | 10043.3 | P | | | | | 0.39 | | | 0.39 | | |
| BDL167 | 10043.3 | Av | | | | | 1.1 | | | 1.1 | | |
| BDL167 | 10044.2 | P | | | | 0.21 | 0.17 | 0.31 | 0.21 | 0.17 | 0.31 | 0.03 |
| BDL167 | 10044.2 | Av | | | | 1.14 | 1.15 | 1.2 | 1.14 | 1.15 | 1.2 | 1.09 |
| BDL168 | 9881.3 | P | 0.1 | 0.11 | 0.09 | 0.18 | 0.14 | 0.09 | 0.18 | 0.14 | 0.1 | 0.22 |
| BDL168 | 9881.3 | Av | 1.22 | 1.19 | 1.24 | 1.48 | 1.44 | 1.49 | 1.5 | 1.46 | 1.52 | 1.14 |
| BDL168 | 9881.4 | P | 0.14 | 0.24 | 0.18 | 0.05 | 0.11 | 0.27 | 0.05 | 0.11 | 0.26 | 0.4 |
| BDL168 | 9881.4 | Av | 1.23 | 1.17 | 1.19 | 1.43 | 1.38 | 1.34 | 1.45 | 1.4 | 1.35 | 1.1 |
| BDL168 | 9882.1 | P | | | | 0.04 | 0.05 | 0.12 | 0.01 | 0.02 | 0.05 | |
| BDL168 | 9882.1 | Av | | | | 1.14 | 1.12 | 1.1 | 1.15 | 1.13 | 1.11 | |
| BDL168 | 9882.3 | P | 0.58 | 0.64 | 0.49 | 0.51 | 0.55 | 0.51 | 0.49 | 0.53 | 0.5 | 0.54 |
| BDL168 | 9882.3 | Av | 1.1 | 1.11 | 1.17 | 1.3 | 1.24 | 1.33 | 1.32 | 1.26 | 1.35 | 1.1 |
| BDL168 | 9884.4 | P | | | 0.72 | | | 0.76 | | | 0.74 | |
| BDL168 | 9884.4 | Av | | | 1.11 | | | 1.13 | | | 1.15 | |
| BDL168 | 9881.4 | P | | 0.02 | | | | 0.51 | | | 0.51 | |
| BDL168 | 9881.4 | Av | | 1.09 | | | | 1.15 | | | 1.15 | |
| BDL168 | 9882.1 | P | | 0.04 | | | 0.15 | 0.22 | | | | |
| BDL168 | 9882.1 | Av | | 1.07 | | | 1.12 | 1.13 | | | | |
| BDL168 | 9884.1 | P | | | 0.01 | | | | | | | |
| BDL168 | 9884.1 | Av | | | 1.1 | | | | | | | |
| BDL169 | 10743.4 | P | | | | 0.43 | 0.55 | 0.56 | 0.54 | 0.7 | 0.72 | |
| BDL169 | 10743.4 | Av | | | | 1.27 | 1.2 | 1.19 | 1.17 | 1.11 | 1.1 | |
| BDL169 | 10744.1 | P | 0.41 | | | 0.37 | 0.55 | | 0.3 | 0.45 | 0.69 | 0.43 |
| BDL169 | 10744.1 | Av | 1.1 | | | 1.27 | 1.18 | | 1.35 | 1.25 | 1.1 | 1.13 |
| BDL169 | 10747.1 | P | 0.29 | | | 0.47 | 0.64 | | 0.42 | 0.54 | | <0.01 |
| BDL169 | 10747.1 | Av | 1.15 | | | 1.34 | 1.15 | | 1.42 | 1.22 | | 1.17 |

TABLE 24-continued

Results from greenhouse experiments

| Gene | Ev. | Par: | 1 | 2 | 3 | 4 | 5 | 6 | 7 | 8 | 9 | 10 |
|---|---|---|---|---|---|---|---|---|---|---|---|---|
| BDL169 | 10747.5 | P |  | 0.08 |  | 0.01 | 0.02 | 0.24 | 0.01 | 0.01 | 0.13 | <0.01 |
| BDL169 | 10747.5 | Av |  | 1.09 |  | 1.4 | 1.28 | 1.11 | 1.49 | 1.36 | 1.18 | 1.16 |
| BDL169 | 10741.3 | P | 0.58 |  |  | 0.43 |  |  | 0.43 |  |  |  |
| BDL169 | 10741.3 | Av | 1.13 |  |  | 1.2 |  |  | 1.2 |  |  |  |
| BDL169 | 10744.2 | P | 0.43 | 0.25 | 0.18 | 0.34 | 0.31 | 0.33 | 0.34 | 0.31 | 0.33 | 0.44 |
| BDL169 | 10744.2 | Av | 1.24 | 1.26 | 1.21 | 1.6 | 1.61 | 1.42 | 1.6 | 1.61 | 1.42 | 1.12 |
| BDL169 | 10747.1 | P | 0.01 | 0.14 |  | 0.33 | 0.09 | 0.53 | 0.33 | 0.09 | 0.53 |  |
| BDL169 | 10747.1 | Av | 1.16 | 1.15 |  | 1.44 | 1.3 | 1.17 | 1.44 | 1.3 | 1.17 |  |
| BDL169 | 10747.5 | P | 0.05 | 0.1 | 0.01 | 0.16 | 0.19 | 0.05 | 0.16 | 0.19 | 0.05 |  |
| BDL169 | 10747.5 | Av | 1.13 | 1.08 | 1.09 | 1.28 | 1.24 | 1.12 | 1.28 | 1.24 | 1.12 |  |
| BDL171 | 10661.2 | P | 0.7 |  | 0.44 | 0.59 | 0.7 | 0.56 | 0.59 | 0.7 | 0.56 |  |
| BDL171 | 10661.2 | Av | 1.1 |  | 1.1 | 1.23 | 1.17 | 1.22 | 1.23 | 1.17 | 1.22 |  |
| BDL171 | 10662.3 | P | 0.48 | 0.44 |  | 0.35 | 0.53 |  | 0.35 | 0.53 |  |  |
| BDL171 | 10662.3 | Av | 1.12 | 1.13 |  | 1.26 | 1.19 |  | 1.26 | 1.19 |  |  |
| BDL171 | 10664.1 | P | 0.01 | <0.01 | 0.24 | <0.01 | 0.01 | 0.42 | <0.01 | 0.01 | 0.42 | <0.01 |
| BDL171 | 10664.1 | Av | 1.36 | 1.31 | 1.23 | 1.72 | 1.56 | 1.49 | 1.72 | 1.56 | 1.49 | 1.21 |
| BDL171 | 10664.3 | P | 0.16 | 0.16 | 0.38 | 0.24 | 0.15 | 0.42 | 0.24 | 0.15 | 0.42 | 0.03 |
| BDL171 | 10664.3 | Av | 1.26 | 1.22 | 1.14 | 1.49 | 1.44 | 1.36 | 1.49 | 1.44 | 1.36 | 1.19 |
| BDL171 | 10661.5 | P |  |  |  |  |  |  | 0.29 | 0.38 |  | 0.42 |
| BDL171 | 10661.5 | Av |  |  |  |  |  |  | 1.15 | 1.1 |  | 1.12 |
| BDL171 | 10662.2 | P | 0.01 | 0.07 |  | 0.18 |  |  | 0.11 |  |  | 0.15 |
| BDL171 | 10662.2 | Av | 1.16 | 1.1 |  | 1.2 |  |  | 1.28 |  |  | 1.18 |
| BDL171 | 10662.3 | P | 0.02 | <0.01 | <0.01 | <0.01 | <0.01 | 0.01 | <0.01 | <0.01 | <0.01 | <0.01 |
| BDL171 | 10662.3 | Av | 1.28 | 1.29 | 1.2 | 1.57 | 1.52 | 1.33 | 1.67 | 1.61 | 1.41 | 1.25 |
| BDL171 | 10663.3 | P | <0.01 | <0.01 |  | <0.01 | 0.04 |  | <0.01 | 0.02 |  | 0.03 |
| BDL171 | 10663.3 | Av | 1.26 | 1.18 |  | 1.32 | 1.21 |  | 1.4 | 1.28 |  | 1.18 |
| BDL171 | 10664.1 | P |  |  |  | 0.76 | 0.81 |  | 0.69 | 0.75 | 0.85 |  |
| BDL171 | 10664.1 | Av |  |  |  | 1.19 | 1.14 |  | 1.26 | 1.21 | 1.11 |  |
| BDL171 | 10664.3 | P | 0.01 | 0.12 |  | 0.14 | 0.17 | 0.58 | 0.11 | 0.12 | 0.47 | 0.07 |
| BDL171 | 10664.3 | Av | 1.23 | 1.15 |  | 1.44 | 1.3 | 1.16 | 1.52 | 1.37 | 1.23 | 1.25 |
| BDL173 | 9952.1 | P |  |  |  |  |  | 0.67 |  |  | 0.64 |  |
| BDL173 | 9952.1 | Av |  |  |  |  |  | 1.11 |  |  | 1.13 |  |
| BDL177 | 10521.3 | P |  |  |  | 0.56 |  |  | 0.56 |  |  |  |
| BDL177 | 10521.3 | Av |  |  |  | 1.15 |  |  | 1.15 |  |  |  |
| BDL177 | 10524.2 | P |  |  |  | 0.09 |  | 0.44 | 0.09 |  | 0.44 |  |
| BDL177 | 10524.2 | Av |  |  |  | 1.2 |  | 1.1 | 1.2 |  | 1.1 |  |
| BDL182 | 10691.2 | P |  |  |  |  | 0.27 |  |  | 0.27 |  | 0.46 |
| BDL182 | 10691.2 | Av |  |  |  |  | 1.12 |  |  | 1.12 |  | 1.11 |
| BDL182 | 10692.3 | P | 0.44 |  |  | 0.43 | 0.37 |  | 0.43 | 0.37 |  | 0.05 |
| BDL182 | 10692.3 | Av | 1.11 |  |  | 1.25 | 1.12 |  | 1.25 | 1.12 |  | 1.08 |
| BDL182 | 10693.2 | P |  |  |  |  | 0.65 |  |  | 0.65 |  |  |
| BDL182 | 10693.2 | Av |  |  |  |  | 1.1 |  |  | 1.1 |  |  |
| BDL182 | 10693.3 | P | 0.03 | 0.08 |  | 0.16 | 0.06 | 0.38 | 0.16 | 0.06 | 0.38 |  |
| BDL182 | 10693.3 | Av | 1.19 | 1.15 |  | 1.22 | 1.18 | 1.12 | 1.22 | 1.18 | 1.12 |  |
| BDL182 | 10693.5 | P |  |  |  | 0.48 |  |  | 0.48 |  |  |  |
| BDL182 | 10693.5 | Av |  |  |  | 1.1 |  |  | 1.1 |  |  |  |
| BDL182 | 10691.4 | P | 0.51 | 0.43 |  | 0.39 | 0.44 |  | 0.47 | 0.6 |  | 0.32 |
| BDL182 | 10691.4 | Av | 1.11 | 1.11 |  | 1.36 | 1.21 |  | 1.26 | 1.13 |  | 1.19 |
| BDL182 | 10691.8 | P |  |  |  |  |  |  | 0.87 |  |  |  |
| BDL182 | 10691.8 | Av |  |  |  |  |  |  | 1.1 |  |  |  |
| BDL183 | 9941.1 | P |  |  |  |  |  | 0.21 | 0.16 |  | 0.16 |  |
| BDL183 | 9941.1 | Av |  |  |  |  |  | 1.11 | 1.11 |  | 1.13 |  |
| BDL183 | 9943.4 | P |  |  |  |  |  | 0.3 |  |  |  |  |
| BDL183 | 9943.4 | Av |  |  |  |  |  | 1.1 |  |  |  |  |
| BDL183 | 9944.1 | P | 0.09 | 0.03 |  | 0.1 | 0.15 | 0.22 | 0.1 | 0.15 | 0.21 |  |
| BDL183 | 9944.1 | Av | 1.16 | 1.12 |  | 1.27 | 1.23 | 1.22 | 1.29 | 1.25 | 1.24 |  |
| BDL183 | 9941.1 | P |  |  |  |  |  | 0.65 |  |  | 0.65 |  |
| BDL183 | 9941.1 | Av |  |  |  |  |  | 1.11 |  |  | 1.11 |  |
| BDL183 | 9942.1 | P | 0.02 | 0.02 |  | 0.16 | 0.33 | 0.38 | 0.16 | 0.33 | 0.38 |  |
| BDL183 | 9942.1 | Av | 1.16 | 1.1 |  | 1.12 | 1.17 | 1.13 | 1.12 | 1.17 | 1.13 |  |
| BDL186 | 10002.2 | P |  |  | 0.1 |  | 0.05 | <0.01 |  | 0.02 | <0.01 |  |
| BDL186 | 10002.2 | Av |  |  | 1.07 |  | 1.13 | 1.25 |  | 1.14 | 1.27 |  |
| BDL186 | 10004.3 | P |  |  | 0.6 |  |  | 0.69 |  |  | 0.66 |  |
| BDL186 | 10004.3 | Av |  |  | 1.11 |  |  | 1.15 |  |  | 1.17 |  |
| BDL186 | 10001.3 | P |  |  |  |  |  |  |  |  |  | 0.53 |
| BDL186 | 10001.3 | Av |  |  |  |  |  |  |  |  |  | 1.11 |
| BDL186 | 10004.6 | P |  |  |  | 0.43 |  |  | 0.43 |  |  | 0.1 |
| BDL186 | 10004.6 | Av |  |  |  | 1.2 |  |  | 1.2 |  |  | 1.08 |
| BDL187 | 10502.2 | P |  |  |  | 0.29 |  |  | 0.6 |  |  |  |
| BDL187 | 10502.2 | Av |  |  |  | 1.2 |  |  | 1.13 |  |  |  |
| BDL187 | 10503.1 | P |  |  |  | 0.09 | 0.27 |  | 0.09 | 0.27 |  |  |
| BDL187 | 10503.1 | Av |  |  |  | 1.26 | 1.1 |  | 1.26 | 1.1 |  |  |
| BDL187 | 10503.3 | P |  |  |  | 0.66 |  |  | 0.66 |  |  |  |
| BDL187 | 10503.3 | Av |  |  |  | 1.16 |  |  | 1.16 |  |  |  |
| BDL187 | 10503.5 | P | 0.26 |  |  |  |  |  |  |  |  |  |
| BDL187 | 10503.5 | Av | 1.1 |  |  |  |  |  |  |  |  |  |

TABLE 24-continued

Results from greenhouse experiments

| Gene | Ev. | Par: | 1 | 2 | 3 | 4 | 5 | 6 | 7 | 8 | 9 | 10 |
|---|---|---|---|---|---|---|---|---|---|---|---|---|
| BDL188 | 10462.4 | P | | | | 0.14 | 0.07 | | 0.14 | 0.07 | | 0.32 |
| BDL188 | 10462.4 | Av | | | | 1.13 | 1.09 | | 1.13 | 1.09 | | 1.13 |
| BDL188 | 10462.1 | P | 0.02 | 0.11 | | 0.04 | 0.11 | 0.4 | 0.04 | 0.11 | 0.4 | |
| BDL188 | 10462.1 | Av | 1.2 | 1.14 | | 1.3 | 1.27 | 1.21 | 1.3 | 1.27 | 1.21 | |
| BDL188 | 10462.4 | P | 0.03 | 0.03 | 0.14 | | 0.09 | 0.1 | | 0.09 | 0.1 | |
| BDL188 | 10462.4 | Av | 1.16 | 1.16 | 1.1 | | 1.24 | 1.23 | | 1.24 | 1.23 | |
| BDL190 | 10232.2 | P | 0.01 | 0.01 | <0.01 | 0.43 | 0.09 | 0.14 | 0.43 | 0.09 | 0.14 | |
| BDL190 | 10232.2 | Av | 1.18 | 1.15 | 1.13 | 1.17 | 1.25 | 1.24 | 1.17 | 1.25 | 1.24 | |
| BDL190 | 10233.2 | P | 0.03 | <0.01 | 0.09 | 0.03 | 0.01 | <0.01 | 0.03 | 0.01 | <0.01 | |
| BDL190 | 10233.2 | Av | 1.14 | 1.16 | 1.18 | 1.19 | 1.35 | 1.29 | 1.19 | 1.35 | 1.29 | |
| BDL190 | 10233.4 | P | | | 0.11 | 0.18 | | <0.01 | 0.18 | | <0.01 | |
| BDL190 | 10233.4 | Av | | | 1.11 | 1.11 | | 1.17 | 1.11 | | 1.17 | |
| BDL190 | 10234.2 | P | | 0.09 | | | 0.05 | | | 0.05 | | |
| BDL190 | 10234.2 | Av | | 1.06 | | | 1.18 | | | 1.18 | | |
| BDL192 | 9921.6 | P | | | | 0.26 | 0.4 | 0.48 | 0.23 | 0.37 | 0.44 | |
| BDL192 | 9921.6 | Av | | | | 1.14 | 1.14 | 1.13 | 1.16 | 1.15 | 1.14 | |
| BDL192 | 9922.1 | P | 0.11 | | | 0.35 | 0.33 | 0.28 | 0.33 | 0.3 | 0.22 | |
| BDL192 | 9922.1 | Av | 1.1 | | | 1.21 | 1.14 | 1.1 | 1.23 | 1.15 | 1.12 | |
| BDL192 | 9921.6 | P | | | | 0.21 | 0.14 | 0.41 | 0.21 | 0.14 | 0.41 | |
| BDL192 | 9921.6 | Av | | | | 1.12 | 1.14 | 1.14 | 1.12 | 1.14 | 1.14 | |
| BDL192 | 9922.5 | P | | | | 0.35 | 0.33 | 0.3 | 0.65 | 0.62 | | |
| BDL192 | 9922.5 | Av | | | | 1.18 | 1.2 | 1.13 | 1.11 | 1.13 | | |
| BDL193 | 10152.2 | P | | | | 0.08 | | | 0.06 | 0.17 | | 0.01 |
| BDL193 | 10152.2 | Av | | | | 1.15 | | | 1.16 | 1.1 | | 1.06 |
| BDL193 | 10153.2 | P | | | | | | | 0.6 | | | |
| BDL193 | 10153.2 | Av | | | | | | | 1.11 | | | |
| BDL193 | 10153.4 | P | | | 0.04 | 0.4 | 0.37 | 0.21 | 0.38 | 0.34 | 0.18 | |
| BDL193 | 10153.4 | Av | | | 1.08 | 1.23 | 1.16 | 1.16 | 1.25 | 1.18 | 1.17 | |
| BDL193 | 10153.3 | P | 0.41 | 0.14 | | 0.4 | 0.01 | 0.4 | 0.4 | 0.01 | 0.4 | 0.33 |
| BDL193 | 10153.3 | Av | 1.12 | 1.15 | | 1.21 | 1.31 | 1.14 | 1.21 | 1.31 | 1.14 | 1.13 |
| BDL193 | 10153.4 | P | 0.33 | 0.25 | | 0.51 | 0.27 | 0.17 | 0.51 | 0.27 | 0.17 | |
| BDL193 | 10153.4 | Av | 1.1 | 1.11 | | 1.14 | 1.23 | 1.14 | 1.14 | 1.23 | 1.14 | |
| BDL196 | 10243.1 | P | 0.61 | 0.66 | | 0.6 | 0.66 | 0.66 | 0.6 | 0.66 | 0.66 | |
| BDL196 | 10243.1 | Av | 1.14 | 1.1 | | 1.2 | 1.16 | 1.15 | 1.2 | 1.16 | 1.15 | |
| BDL196 | 10243.1 | P | | | 0.02 | | | | | | | |
| BDL196 | 10243.1 | Av | | | 1.05 | | | | | | | |
| BDL201 | 9961.3 | P | 0.26 | 0.22 | 0.38 | 0.11 | 0.23 | 0.44 | 0.11 | 0.23 | 0.44 | 0.09 |
| BDL201 | 9961.3 | Av | 1.13 | 1.11 | 1.16 | 1.33 | 1.23 | 1.35 | 1.33 | 1.23 | 1.35 | 1.07 |
| BDL220 | 10333.5 | P | | | 0.48 | | | | | | | |
| BDL220 | 10333.5 | Av | | | 1.1 | | | | | | | |
| BDL223 | 10793.5 | P | 0.09 | 0.01 | 0.01 | 0.39 | 0.12 | 0.26 | 0.39 | 0.12 | 0.26 | 0.02 |
| BDL223 | 10793.5 | Av | 1.15 | 1.12 | 1.1 | 1.12 | 1.25 | 1.13 | 1.12 | 1.25 | 1.13 | 1.06 |
| BDL223 | 10793.8 | P | <0.01 | 0.01 | | 0.2 | 0.19 | | 0.2 | 0.19 | | |
| BDL223 | 10793.8 | Av | 1.17 | 1.1 | | 1.31 | 1.18 | | 1.31 | 1.18 | | |
| BDL224 | 10451.7 | P | | | | 0.59 | | | 0.59 | | | 0.05 |
| BDL224 | 10451.7 | Av | | | | 1.12 | | | 1.12 | | | 1.08 |
| BDL226 | 10861.2 | P | 0.05 | 0.05 | | 0.01 | 0.07 | | 0.01 | 0.04 | | 0.03 |
| BDL226 | 10861.2 | Av | 1.12 | 1.12 | | 1.26 | 1.17 | | 1.34 | 1.24 | | 1.21 |
| BDL226 | 10861.4 | P | | | | | | | 0.65 | | | 0.31 |
| BDL226 | 10861.4 | Av | | | | | | | 1.13 | | | 1.12 |
| BDL226 | 10864.2 | P | 0.01 | 0.01 | 0.09 | <0.01 | <0.01 | 0.07 | <0.01 | <0.01 | 0.04 | 0.22 |
| BDL226 | 10864.2 | Av | 1.2 | 1.15 | 1.09 | 1.49 | 1.34 | 1.21 | 1.59 | 1.42 | 1.29 | 1.13 |
| BDL227 | 11491.3 | P | 0.21 | 0.01 | 0.08 | 0.27 | 0.07 | | 0.27 | 0.07 | | |
| BDL227 | 11491.3 | Av | 1.11 | 1.09 | 1.09 | 1.12 | 1.21 | | 1.12 | 1.21 | | |
| BDL227 | 11492.3 | P | <0.01 | <0.01 | | | 0.01 | 0.05 | | 0.01 | 0.05 | |
| BDL227 | 11492.3 | Av | 1.17 | 1.12 | | | 1.23 | 1.12 | | 1.23 | 1.12 | |
| BDL233 | 10822.1 | P | | | | 0.63 | | | 0.63 | | | |
| BDL233 | 10822.1 | Av | | | | 1.12 | | | 1.12 | | | |
| BDL233 | 10825.4 | P | 0.4 | 0.4 | 0.37 | 0.63 | 0.35 | 0.48 | 0.63 | 0.35 | 0.48 | |
| BDL233 | 10825.4 | Av | 1.16 | 1.16 | 1.16 | 1.14 | 1.39 | 1.25 | 1.14 | 1.39 | 1.25 | |
| BDL237 | 10893.1 | P | | | | 0.09 | | | 0.09 | | | |
| BDL237 | 10893.1 | Av | | | | 1.12 | | | 1.12 | | | |
| BDL237 | 10895.1 | P | 0.37 | 0.29 | | 0.05 | 0.56 | 0.55 | 0.05 | 0.56 | 0.55 | |
| BDL237 | 10895.1 | Av | 1.13 | 1.1 | | 1.13 | 1.15 | 1.11 | 1.13 | 1.15 | 1.11 | |
| BDL237 | 10895.2 | P | | | | 0.29 | | | 0.29 | | | |
| BDL237 | 10895.2 | Av | | | | 1.12 | | | 1.12 | | | |
| BDL237 | 10895.3 | P | 0.55 | | | 0.56 | | | 0.56 | | | |
| BDL237 | 10895.3 | Av | 1.13 | | | 1.12 | | | 1.12 | | | |
| BDL238 | 10951.4 | P | 0.35 | | | | 0.1 | | | 0.1 | | |
| BDL238 | 10951.4 | Av | 1.11 | | | | 1.14 | | | 1.14 | | |
| BDL238 | 10952.3 | P | | | | | 0.68 | | | 0.68 | | |
| BDL238 | 10952.3 | Av | | | | | 1.1 | | | 1.1 | | |
| BDL238 | 10954.2 | P | 0.04 | <0.01 | <0.01 | 0.08 | <0.01 | <0.01 | 0.08 | <0.01 | <0.01 | <0.01 |
| BDL238 | 10954.2 | Av | 1.33 | 1.28 | 1.23 | 1.73 | 1.76 | 1.52 | 1.73 | 1.76 | 1.52 | 1.13 |
| BDL238 | 10954.3 | P | | | | 0.74 | | | 0.74 | | | |
| BDL238 | 10954.3 | Av | | | | 1.13 | | | 1.13 | | | |

TABLE 24-continued

Results from greenhouse experiments

| Gene | Ev. | Par: | 1 | 2 | 3 | 4 | 5 | 6 | 7 | 8 | 9 | 10 |
|---|---|---|---|---|---|---|---|---|---|---|---|---|
| BDL240 | 10802.2 | P | 0.02 | 0.03 | 0.12 | 0.1 | 0.02 | 0.04 | 0.1 | 0.02 | 0.04 | |
| BDL240 | 10802.2 | Av | 1.22 | 1.26 | 1.18 | 1.34 | 1.54 | 1.35 | 1.34 | 1.54 | 1.35 | |
| BDL241 | 10873.1 | P | 0.02 | 0.13 | 0.11 | <0.01 | 0.38 | 0.02 | <0.01 | 0.38 | 0.02 | |
| BDL241 | 10873.1 | Av | 1.19 | 1.18 | 1.15 | 1.41 | 1.3 | 1.34 | 1.41 | 1.3 | 1.34 | |
| BDL242 | 10731.2 | P | 0.4 | 0.52 | | 0.14 | 0.46 | 0.58 | 0.14 | 0.46 | 0.58 | |
| BDL242 | 10731.2 | Av | 1.13 | 1.12 | | 1.22 | 1.28 | 1.14 | 1.22 | 1.28 | 1.14 | |
| BDL242 | 10731.5 | P | | | | 0.1 | | | 0.1 | | | |
| BDL242 | 10731.5 | Av | | | | 1.11 | | | 1.11 | | | |
| BDL242 | 10731.6 | P | <0.01 | <0.01 | 0.18 | 0.03 | 0.25 | 0.08 | 0.03 | 0.25 | 0.08 | |
| BDL242 | 10731.6 | Av | 1.21 | 1.22 | 1.19 | 1.48 | 1.45 | 1.36 | 1.48 | 1.45 | 1.36 | |
| BDL242 | 10731.7 | P | | | | 0.06 | | | 0.06 | | | |
| BDL242 | 10731.7 | Av | | | | 1.12 | | | 1.12 | | | |
| BDL245 | 10813.3 | P | | 0.03 | | | | | | | | |
| BDL245 | 10813.3 | Av | | 1.08 | | | | | | | | |
| BDL250 | 10841.3 | P | 0.02 | 0.18 | 0.26 | 0.06 | 0.22 | 0.32 | 0.06 | 0.22 | 0.32 | 0.05 |
| BDL250 | 10841.3 | Av | 1.24 | 1.18 | 1.11 | 1.36 | 1.41 | 1.17 | 1.36 | 1.41 | 1.17 | 1.08 |
| BDL250 | 10846.2 | P | 0.48 | | | 0.64 | 0.41 | | 0.64 | 0.41 | | |
| BDL250 | 10846.2 | Av | 1.1 | | | 1.12 | 1.16 | | 1.12 | 1.16 | | |
| BDL250 | 10846.3 | P | 0.38 | 0.36 | 0.48 | 0.58 | 0.46 | 0.62 | 0.58 | 0.46 | 0.62 | |
| BDL250 | 10846.3 | Av | 1.11 | 1.17 | 1.11 | 1.17 | 1.34 | 1.19 | 1.17 | 1.34 | 1.19 | |
| BDL252 | 10882.1 | P | 0.3 | 0.41 | 0.44 | 0.32 | 0.26 | 0.34 | 0.32 | 0.26 | 0.34 | <0.01 |
| BDL252 | 10882.1 | Av | 1.19 | 1.19 | 1.17 | 1.38 | 1.42 | 1.24 | 1.38 | 1.42 | 1.24 | 1.1 |
| BDL48 | 10274.4 | P | 0.23 | 0.02 | 0.02 | 0.81 | 0.09 | 0.08 | 0.81 | 0.09 | 0.08 | |
| BDL48 | 10274.4 | Av | 1.14 | 1.15 | 1.2 | 1.1 | 1.23 | 1.36 | 1.1 | 1.23 | 1.36 | |
| BDL48 | 10271.1 | P | | 0.06 | <0.01 | 0.27 | 0.03 | <0.01 | 0.27 | 0.03 | <0.01 | |
| BDL48 | 10271.1 | Av | | 1.08 | 1.16 | 1.11 | 1.22 | 1.27 | 1.11 | 1.22 | 1.27 | |
| BDL48 | 10274.3 | P | 0.07 | 0.01 | <0.01 | 0.02 | 0.01 | <0.01 | 0.02 | 0.01 | <0.01 | |
| BDL48 | 10274.3 | Av | 1.21 | 1.19 | 1.09 | 1.25 | 1.35 | 1.22 | 1.25 | 1.35 | 1.22 | |
| BDL48 | 10274.4 | P | 0.29 | 0.2 | 0.13 | 0.22 | 0.03 | 0.22 | 0.22 | 0.03 | 0.22 | |
| BDL48 | 10274.4 | Av | 1.14 | 1.15 | 1.14 | 1.14 | 1.21 | 1.26 | 1.14 | 1.21 | 1.26 | |
| BDL48 | 10274.5 | P | 0.04 | 0.28 | 0.45 | 0.26 | 0.49 | 0.44 | 0.26 | 0.49 | 0.44 | |
| BDL48 | 10274.5 | Av | 1.11 | 1.13 | 1.11 | 1.14 | 1.22 | 1.22 | 1.14 | 1.22 | 1.22 | |
| BDL63 | 10381.1 | P | 0.12 | 0.02 | <0.01 | 0.11 | 0.21 | <0.01 | 0.11 | 0.21 | <0.01 | |
| BDL63 | 10381.1 | Av | 1.2 | 1.18 | 1.17 | 1.2 | 1.39 | 1.37 | 1.2 | 1.39 | 1.37 | |
| BDL63 | 10381.2 | P | 0.03 | 0.25 | 0.37 | 0.31 | 0.6 | 0.42 | 0.31 | 0.6 | 0.42 | |
| BDL63 | 10381.2 | Av | 1.13 | 1.15 | 1.19 | 1.19 | 1.26 | 1.32 | 1.19 | 1.26 | 1.32 | |
| BDL63 | 10384.8 | P | | 0.02 | <0.01 | | 0.06 | <0.01 | | 0.06 | <0.01 | |
| BDL63 | 10384.8 | Av | | 1.09 | 1.14 | | 1.2 | 1.24 | | 1.2 | 1.24 | |
| BDL79 | 11042.1 | P | | 0.08 | | | 0.04 | 0.52 | | 0.04 | 0.52 | |
| BDL79 | 11042.1 | Av | | 1.06 | | | 1.16 | 1.1 | | 1.16 | 1.1 | |
| BDL79 | 11044.3 | P | <0.01 | 0.03 | | | 0.14 | | | 0.14 | | |
| BDL79 | 11044.3 | Av | 1.17 | 1.11 | | | 1.14 | | | 1.14 | | |
| BDL81 | 10371.8 | P | | | | 0.34 | | | 0.34 | | | |
| BDL81 | 10371.8 | Av | | | | 1.12 | | | 1.12 | | | |
| BDL81 | 10374.1 | P | | | | 0.22 | | | 0.22 | | | |
| BDL81 | 10374.1 | Av | | | | 1.16 | | | 1.16 | | | |
| BDL81 | 10371.5 | P | | 0.02 | 0.17 | | | 0.21 | | | 0.21 | |
| BDL81 | 10371.5 | Av | | 1.08 | 1.11 | | | 1.13 | | | 1.13 | |
| BDL81 | 10371.8 | P | | | 0.6 | | 0.8 | 0.57 | | 0.8 | 0.57 | |
| BDL81 | 10371.8 | Av | | | 1.13 | | 1.13 | 1.22 | | 1.13 | 1.22 | |
| BDL81 | 10374.1 | P | 0.26 | 0.31 | 0.44 | 0.16 | 0.19 | 0.32 | 0.16 | 0.19 | 0.32 | 0.26 |
| BDL81 | 10374.1 | Av | 1.23 | 1.22 | 1.19 | 1.44 | 1.45 | 1.49 | 1.44 | 1.45 | 1.49 | 1.12 |
| BDL85 | 10411.1 | P | 0.25 | 0.34 | 0.15 | 0.13 | 0.39 | 0.33 | 0.13 | 0.39 | 0.33 | 0.12 |
| BDL85 | 10411.1 | Av | 1.2 | 1.16 | 1.14 | 1.39 | 1.29 | 1.28 | 1.39 | 1.29 | 1.28 | 1.16 |

Table 24.
Results of the greenhouse experiments.
Provided are the measured values of each parameter [parameters (Par.) 1-10 according to the parameters described in Table 23 above] in plants expressing the indicated polynucleotides.
"Ev" = event;
"P" = P-value;
"Av" = ratio between the averages of event and control.
Note that when the average ratio is higher than "1" the effect of exogenous expression of the gene is an increase of the desired trait;

TABLE 25

Results from greenhouse experiments

| Gene | Ev. | Par | 11 | 12 | 13 | 14 | 15 | 16 | 17 | 18 | 19 | 20 |
|---|---|---|---|---|---|---|---|---|---|---|---|---|
| BDL102 | 10471.1 | P | | | 0.1 | 0.27 | 0.03 | 0.04 | 0.29 | | | |
| BDL102 | 10471.1 | Av | | | 1.35 | 1.23 | 1.18 | 1.27 | 1.1 | | | |
| BDL102 | 10472.1 | P | | | 0.17 | 0.35 | 0.25 | 0.21 | 0.22 | | | |
| BDL102 | 10472.1 | Av | | | 1.36 | 1.23 | 1.3 | 1.29 | 1.15 | | | |

TABLE 25-continued

Results from greenhouse experiments

| Gene | Ev. | Par | 11 | 12 | 13 | 14 | 15 | 16 | 17 | 18 | 19 | 20 |
|---|---|---|---|---|---|---|---|---|---|---|---|---|
| BDL102 | 10474.1 | P | | | 0.18 | 0.19 | 0.16 | 0.17 | 0.3 | | | 0.02 |
| BDL102 | 10474.1 | Av | | | 1.56 | 1.82 | 1.54 | 1.4 | 1.3 | | | 1.03 |
| BDL102 | 10474.2 | P | | | 0.04 | <0.01 | 0.01 | 0.15 | <0.01 | | | |
| BDL102 | 10474.2 | Av | | | 1.51 | 1.48 | 1.34 | 1.42 | 1.22 | | | |
| BDL102 | 10474.6 | P | | | 0.23 | | | 0.11 | | | | |
| BDL102 | 10474.6 | Av | | | 1.19 | | | 1.12 | | | | |
| BDL117 | 10071.2 | P | | | | | | | | | | 0.1 |
| BDL117 | 10071.2 | Av | | | | | | | | | | 1.03 |
| BDL117 | 10073.2 | P | | | | | | 0.02 | 0.15 | | | |
| BDL117 | 10073.2 | Av | | | | | | 1.1 | 1.1 | | | |
| BDL117 | 10074.1 | P | | 0.21 | 0.27 | 0.29 | 0.26 | 0.18 | 0.12 | 0.04 | | |
| BDL117 | 10074.1 | Av | | 1.19 | 1.46 | 1.38 | 1.33 | 1.59 | 1.35 | 1.17 | | |
| BDL117 | 10074.4 | P | 0.05 | 0.37 | 0.38 | 0.49 | 0.3 | 0.25 | 0.31 | | | 0.03 |
| BDL117 | 10074.4 | Av | 1.06 | 1.12 | 1.28 | 1.16 | 1.19 | 1.43 | 1.28 | | | 1.02 |
| BDL117 | 10073.1 | P | | | 0.62 | 0.52 | 0.63 | | | | | |
| BDL117 | 10073.1 | Av | | | 1.1 | 1.16 | 1.15 | | | | | |
| BDL117 | 10073.2 | P | | | | 0.56 | 0.37 | 0.35 | 0.53 | 0.51 | | |
| BDL117 | 10073.2 | Av | | | | 1.19 | 1.25 | 1.14 | 1.13 | 1.15 | | |
| BDL117 | 10074.1 | P | | 0.01 | 0.53 | 0.37 | 0.36 | 0.33 | 0.42 | 0.43 | | |
| BDL117 | 10074.1 | Av | | 1.09 | 1.11 | 1.29 | 1.24 | 1.21 | 1.17 | 1.2 | | |
| BDL117 | 10074.4 | P | | | | 0.37 | 0.26 | | 0.24 | 0.16 | | |
| BDL117 | 10074.4 | Av | | | | 1.1 | 1.12 | | 1.13 | 1.11 | | |
| BDL138 | 9811.4 | P | | | | | | 0.06 | | | | |
| BDL138 | 9811.4 | Av | | | | | | 1.09 | | | | |
| BDL138 | 9812.1 | P | | | | | | <0.01 | 0.02 | | | |
| BDL138 | 9812.1 | Av | | | | | | 1.16 | 1.11 | | | |
| BDL138 | 9812.3 | P | 0.05 | | 0.11 | | | 0.37 | 0.52 | | 0.01 | |
| BDL138 | 9812.3 | Av | 1.04 | | 1.13 | | | 1.14 | 1.1 | | 1.03 | |
| BDL138 | 9811.1 | P | | | | | | | | | 0.02 | <0.01 |
| BDL138 | 9811.1 | Av | | | | | | | | | 1.04 | 1.04 |
| BDL138 | 9813.4 | P | | | | | | | | | | <0.01 |
| BDL138 | 9813.4 | Av | | | | | | | | | | 1.04 |
| BDL140 | 10423.1 | P | | | 0.01 | 0.22 | | | | | | |
| BDL140 | 10423.1 | Av | | | 1.29 | 1.19 | | | | | | |
| BDL140 | 10424.3 | P | | | | | | | | | | 0.49 |
| BDL140 | 10424.3 | Av | | | | | | | | | | 1.27 |
| BDL140 | 10424.4 | P | | | | | | 0.64 | 0.68 | | | |
| BDL140 | 10424.4 | Av | | | | | | 1.14 | 1.17 | | | |
| BDL140 | 10423.1 | P | | | | | | | | | 0.03 | |
| BDL140 | 10423.1 | Av | | | | | | | | | 1.04 | |
| BDL147 | 10303.1 | P | | | 0.11 | 0.07 | 0.11 | 0.12 | 0.01 | | | |
| BDL147 | 10303.1 | Av | | | 1.49 | 1.31 | 1.18 | 1.28 | 1.43 | | | |
| BDL147 | 10303.6 | P | | | | | | 0.38 | 0.37 | | | |
| BDL147 | 10303.6 | Av | | | | | | 1.11 | 1.12 | | | |
| BDL147 | 10304.2 | P | | | 0.33 | | | | | | | 0.05 |
| BDL147 | 10304.2 | Av | | | 1.18 | | | | | | | 1.04 |
| BDL147 | 10303.5 | P | | | | 0.41 | | | | | | |
| BDL147 | 10303.5 | Av | | | | 1.1 | | | | | | |
| BDL147 | 10304.2 | P | | | | 0.48 | | | | | | |
| BDL147 | 10304.2 | Av | | | | 1.17 | | | | | | |
| BDL149 | 9823.3 | P | | | 0.23 | | | <0.01 | 0.01 | | | |
| BDL149 | 9823.3 | Av | | | 1.13 | | | 1.38 | 1.21 | | | |
| BDL149 | 9824.3 | P | | 0.09 | | | | | | | | |
| BDL149 | 9824.3 | Av | | 1.04 | | | | | | | | |
| BDL149 | 9824.4 | P | | 0.02 | 0.12 | 0.03 | 0.17 | <0.01 | <0.01 | 0.02 | | |
| BDL149 | 9824.4 | Av | | 1.1 | 1.28 | 1.12 | 1.2 | 1.23 | 1.22 | 1.11 | | |
| BDL149 | 9823.3 | P | | | 0.62 | 0.47 | 0.56 | | | | | |
| BDL149 | 9823.3 | Av | | | 1.13 | 1.16 | 1.12 | | | | | |
| BDL152 | 10431.1 | P | | | 0.31 | | | | | | | |
| BDL152 | 10431.1 | Av | | | 1.1 | | | | | | | |
| BDL152 | 10431.4 | P | | | | 0.16 | 0.47 | 0.27 | | 0.09 | | 0.03 |
| BDL152 | 10431.4 | Av | | | | 1.1 | 1.1 | 1.18 | | 1.18 | | 1.02 |
| BDL152 | 10432.5 | P | | | | 0.18 | 0.62 | | | | | |
| BDL152 | 10432.5 | Av | | | | 1.1 | 1.16 | | | | | |
| BDL152 | 10434.1 | P | | | | | | | 0.76 | | | |
| BDL152 | 10434.1 | Av | | | | | | | 1.11 | | | |
| BDL152 | 10434.4 | P | | | | | | 0.32 | 0.25 | 0.04 | 0.16 | |
| BDL152 | 10434.4 | Av | | | | | | 1.2 | 1.13 | 1.37 | 1.12 | |
| BDL152 | 10434.1 | P | | | | | | | | | 0.03 | |
| BDL152 | 10434.1 | Av | | | | | | | | | 1.04 | |
| BDL152 | 10434.4 | P | | | | | | | | | 0.05 | |
| BDL152 | 10434.4 | Av | | | | | | | | | 1.04 | |
| BDL153 | 10141.3 | P | | | <0.01 | <0.01 | <0.01 | 0.25 | 0.05 | <0.01 | | |
| BDL153 | 10141.3 | Av | | | 1.32 | 1.24 | 1.27 | 1.33 | 1.26 | 1.15 | | |
| BDL153 | 10142.2 | P | 0.03 | 0.33 | 0.28 | 0.54 | 0.41 | 0.2 | 0.33 | 0.55 | | 0.07 |
| BDL153 | 10142.2 | Av | 1.15 | 1.16 | 1.44 | 1.28 | 1.41 | 1.54 | 1.34 | 1.12 | | 1.02 |

TABLE 25-continued

Results from greenhouse experiments

| Gene | Ev. | Par | 11 | 12 | 13 | 14 | 15 | 16 | 17 | 18 | 19 | 20 |
|---|---|---|---|---|---|---|---|---|---|---|---|---|
| BDL153 | 10143.1 | P | 0.01 | | 0.21 | | 0.32 | | 0.05 | | 0.01 | <0.01 |
| BDL153 | 10143.1 | Av | 1.12 | | 1.2 | | 1.14 | | 1.11 | | 1.02 | 1.02 |
| BDL153 | 10144.1 | P | | <0.01 | 0.05 | 0.08 | 0.07 | | | | | |
| BDL153 | 10144.1 | Av | | 1.09 | 1.13 | 1.1 | 1.1 | | | | | |
| BDL153 | 10141.3 | P | | | | 0.06 | 0.02 | 0.02 | 0.24 | | | |
| BDL153 | 10141.3 | Av | | | | 1.14 | 1.1 | 1.26 | 1.19 | | | |
| BDL153 | 10142.2 | P | | 0.1 | 0.17 | 0.35 | 0.06 | 0.02 | 0.05 | 0.04 | | |
| BDL153 | 10142.2 | Av | | 1.05 | 1.1 | 1.17 | 1.22 | 1.48 | 1.31 | 1.26 | | |
| BDL153 | 10142.3 | P | | | | | 0.36 | 0.23 | | | | |
| BDL153 | 10142.3 | Av | | | | | 1.14 | 1.1 | | | | |
| BDL153 | 10143.1 | P | | | | | | 0.15 | | | | |
| BDL153 | 10143.1 | Av | | | | | | 1.14 | | | | |
| BDL153 | 10143.2 | P | | 0.04 | | 0.15 | | 0.07 | | <0.01 | | |
| BDL153 | 10143.2 | Av | | 1.06 | | 1.11 | | 1.2 | | 1.15 | | |
| BDL153 | 10144.1 | P | | | | 0.4 | 0.48 | | 0.24 | 0.08 | | |
| BDL153 | 10144.1 | Av | | | | 1.43 | 1.11 | | 1.34 | 1.13 | | |
| BDL153 | 10144.4 | P | | | | | | | 0.54 | | | |
| BDL153 | 10144.4 | Av | | | | | | | 1.1 | | | |
| BDL154 | 10703.6 | P | | | | | | 0.66 | | | | |
| BDL154 | 10703.6 | Av | | | | | | 1.1 | | | | |
| BDL154 | 10703.8 | P | | | 0.08 | 0.09 | 0.54 | <0.01 | 0.09 | | | |
| BDL154 | 10703.8 | Av | | | 1.47 | 1.41 | 1.13 | 1.47 | 1.22 | | | |
| BDL155 | 9991.5 | P | | | 0.36 | | 0.09 | 0.31 | 0.41 | | | |
| BDL155 | 9991.5 | Av | | | 1.11 | | 1.18 | 1.29 | 1.35 | | | |
| BDL155 | 9991.9 | P | | | | | | | 0.27 | | | |
| BDL155 | 9991.9 | Av | | | | | | | 1.17 | | | |
| BDL155 | 9993.2 | P | | | | | | | 0.64 | | | |
| BDL155 | 9993.2 | Av | | | | | | | 1.12 | | | |
| BDL155 | 9994.3 | P | 0.16 | | 0.31 | 0.08 | 0.12 | 0.12 | 0.09 | 0.41 | | |
| BDL155 | 9994.3 | Av | 1.14 | | 1.1 | 1.16 | 1.17 | 1.43 | 1.44 | 1.12 | | |
| BDL155 | 9993.2 | P | | | | | | | | | 0.06 | |
| BDL155 | 9993.2 | Av | | | | | | | | | 1.03 | |
| BDL155 | 9994.3 | P | | | | | | | | | 0.03 | |
| BDL155 | 9994.3 | Av | | | | | | | | | 1.04 | |
| BDL157 | 9911.4 | P | | | | | | | | | | 0.09 |
| BDL157 | 9911.4 | Av | | | | | | | | | | 1.03 |
| BDL157 | 9914.2 | P | | | | | | | 0.12 | 0.09 | | |
| BDL157 | 9914.2 | Av | | | | | | | 1.11 | 1.06 | | |
| BDL162 | 10492.2 | P | | | | | 0.12 | | 0.44 | | | |
| BDL162 | 10492.2 | Av | | | | | 1.39 | | 1.15 | | | |
| BDL162 | 10492.4 | P | | | | | | | 0.82 | | | |
| BDL162 | 10492.4 | Av | | | | | | | 1.13 | | | |
| BDL162 | 10494.1 | P | | | | | | 0.1 | 0.13 | | | |
| BDL162 | 10494.1 | Av | | | | | | 1.21 | 1.21 | | | |
| BDL167 | 10043.1 | P | | | | | | | | | 0.17 | |
| BDL167 | 10043.1 | Av | | | | | | | | | 1.21 | |
| BDL167 | 10043.2 | P | | | | | | | | | <0.01 | 0.01 |
| BDL167 | 10043.2 | Av | | | | | | | | | 1.04 | 1.03 |
| BDL167 | 10044.2 | P | | | 0.05 | 0.07 | | | | | | 0.03 |
| BDL167 | 10044.2 | Av | | | 1.15 | 1.16 | | | | | | 1.02 |
| BDL167 | 10042.3 | P | | 0.1 | | | | | | 0.2 | | |
| BDL167 | 10042.3 | Av | | 1.05 | | | | | | 1.12 | | |
| BDL167 | 10043.3 | P | | | | 0.35 | 0.19 | 0.38 | | 0.41 | | |
| BDL167 | 10043.3 | Av | | | | 1.11 | 1.1 | 1.14 | | 1.11 | | |
| BDL167 | 10044.2 | P | | | 0.51 | 0.28 | 0.27 | 0.31 | 0.18 | | | |
| BDL167 | 10044.2 | Av | | | 1.1 | 1.14 | 1.15 | 1.17 | 1.17 | | | |
| BDL168 | 9881.3 | P | 0.08 | <0.01 | 0.24 | 0.17 | 0.1 | 0.11 | 0.21 | 0.3 | | <0.01 |
| BDL168 | 9881.3 | Av | 1.09 | 1.1 | 1.32 | 1.36 | 1.44 | 1.17 | 1.21 | 1.15 | | 1.02 |
| BDL168 | 9881.4 | P | | 0.01 | 0.1 | 0.32 | 0.05 | 0.16 | 0.36 | 0.44 | | |
| BDL168 | 9881.4 | Av | | 1.15 | 1.3 | 1.23 | 1.32 | 1.45 | 1.25 | 1.14 | | |
| BDL168 | 9882.3 | P | | | 0.61 | 0.54 | 0.49 | 0.66 | 0.71 | 0.66 | | |
| BDL168 | 9882.3 | Av | | | 1.15 | 1.2 | 1.3 | 1.2 | 1.13 | 1.1 | | |
| BDL168 | 9884.4 | P | | | | | 0.7 | | | | | |
| BDL168 | 9884.4 | Av | | | | | 1.15 | | | | | |
| BDL168 | 9881.4 | P | | | | | 0.57 | 0.57 | 0.37 | 0.4 | | |
| BDL168 | 9881.4 | Av | | | | | 1.11 | 1.1 | 1.17 | 1.14 | | |
| BDL168 | 9882.1 | P | | | | 0.1 | 0.22 | 0.48 | | <0.01 | | |
| BDL168 | 9882.1 | Av | | | | 1.12 | 1.11 | 1.14 | | 1.16 | | |
| BDL168 | 9882.3 | P | | | | | | 0.39 | 0.22 | | | |
| BDL168 | 9882.3 | Av | | | | | | 1.12 | 1.11 | | | |
| BDL168 | 9884.1 | P | | | | | | | 0.11 | | | |
| BDL168 | 9884.1 | Av | | | | | | | 1.12 | | | |
| BDL169 | 10743.4 | P | | | 0.55 | 0.5 | 0.69 | 0.44 | | | | |
| BDL169 | 10743.4 | Av | | | 1.16 | 1.19 | 1.12 | 1.17 | | | | |
| BDL169 | 10744.1 | P | 0.41 | | 0.38 | | | 0.29 | 0.31 | | | |
| BDL169 | 10744.1 | Av | 1.15 | | 1.19 | | | 1.4 | 1.24 | | | |

TABLE 25-continued

| | | Results from greenhouse experiments | | | | | | | | | |
|---|---|---|---|---|---|---|---|---|---|---|---|
| Gene | Ev. | Par | 11 | 12 | 13 | 14 | 15 | 16 | 17 | 18 | 19 | 20 |
| BDL169 | 10747.1 | P | 0.09 | | 0.58 | | | 0.01 | | | | |
| BDL169 | 10747.1 | Av | 1.11 | | 1.22 | | | 1.42 | | | | |
| BDL169 | 10747.5 | P | <0.01 | | 0.14 | 0.06 | | | | | | |
| BDL169 | 10747.5 | Av | 1.11 | | 1.29 | 1.15 | | | | | | |
| BDL169 | 10741.3 | P | | | 0.42 | 0.68 | | 0.53 | | | | |
| BDL169 | 10741.3 | Av | | | 1.17 | 1.11 | | 1.16 | | | | |
| BDL169 | 10744.2 | P | 0.02 | | 0.26 | 0.31 | 0.32 | 0.37 | 0.24 | 0.02 | | 0.02 |
| BDL169 | 10744.2 | Av | 1.04 | | 1.48 | 1.56 | 1.44 | 1.37 | 1.26 | 1.23 | | 1.03 |
| BDL169 | 10747.1 | P | | | 0.34 | <0.01 | 0.36 | 0.02 | 0.02 | | | |
| BDL169 | 10747.1 | Av | | | 1.39 | 1.32 | 1.2 | 1.16 | 1.17 | | | |
| BDL169 | 10747.3 | P | | | | | | | | | | 0.45 |
| BDL169 | 10747.3 | Av | | | | | | | | | | 1.1 |
| BDL169 | 10747.5 | P | | | 0.11 | 0.14 | <0.01 | <0.01 | | | | |
| BDL169 | 10747.5 | Av | | | 1.2 | 1.26 | 1.27 | 1.22 | | | | |
| BDL171 | 10661.2 | P | 0.6 | | 0.63 | 0.74 | 0.35 | 0.84 | 0.55 | | | |
| BDL171 | 10661.2 | Av | 1.11 | | 1.17 | 1.1 | 1.19 | 1.1 | 1.33 | | | |
| BDL171 | 10662.3 | P | | | 0.4 | 0.67 | | 0.5 | 0.15 | | | |
| BDL171 | 10662.3 | Av | | | 1.21 | 1.11 | | 1.18 | 1.46 | | | |
| BDL171 | 10664.1 | P | 0.09 | | <0.01 | <0.01 | 0.48 | 0.03 | <0.01 | 0.01 | | |
| BDL171 | 10664.1 | Av | 1.15 | | 1.56 | 1.44 | 1.42 | 1.57 | 1.6 | 1.29 | | |
| BDL171 | 10664.3 | P | 0.34 | 0.47 | 0.24 | 0.04 | 0.46 | 0.08 | 0.38 | 0.48 | | |
| BDL171 | 10664.3 | Av | 1.19 | 1.12 | 1.3 | 1.29 | 1.18 | 1.39 | 1.43 | 1.26 | | |
| BDL171 | 10661.5 | P | 0.51 | | | | | 0.76 | 0.68 | | | |
| BDL171 | 10661.5 | Av | 1.1 | | | | | 1.11 | 1.12 | | | |
| BDL171 | 10662.2 | P | | | 0.39 | | | 0.06 | 0.42 | | | |
| BDL171 | 10662.2 | Av | | | 1.11 | | | 1.47 | 1.14 | | | |
| BDL171 | 10662.3 | P | 0.09 | | <0.01 | 0.02 | <0.01 | 0.24 | 0.17 | <0.01 | | |
| BDL171 | 10662.3 | Av | 1.3 | | 1.39 | 1.5 | 1.33 | 1.46 | 1.37 | 1.23 | | |
| BDL171 | 10663.3 | P | <0.01 | | 0.04 | 0.07 | | <0.01 | 0.08 | | | |
| BDL171 | 10663.3 | Av | 1.2 | | 1.2 | 1.17 | | 1.54 | 1.24 | | | |
| BDL171 | 10664.1 | P | | | 0.71 | 0.79 | | | | | | 0.01 |
| BDL171 | 10664.1 | Av | | | 1.18 | 1.13 | | | | | | 1.03 |
| BDL171 | 10664.3 | P | 0.08 | | 0.18 | 0.22 | | 0.01 | 0.33 | | 0.09 | |
| BDL171 | 10664.3 | Av | 1.18 | | 1.29 | 1.22 | | 1.54 | 1.23 | | 1.03 | |
| BDL173 | 9951.2 | P | | | | | | | | | <0.01 | |
| BDL173 | 9951.2 | Av | | | | | | | | | 1.03 | |
| BDL173 | 9952.1 | P | | | | | 0.61 | | | | | |
| BDL173 | 9952.1 | Av | | | | | 1.13 | | | | | |
| BDL173 | 9954.3 | P | | | | | | | | | <0.01 | 0.02 |
| BDL173 | 9954.3 | Av | | | | | | | | | 1.05 | 1.04 |
| BDL173 | 9953.4 | P | | | | | | | | | <0.01 | |
| BDL173 | 9953.4 | Av | | | | | | | | | 1.03 | |
| BDL177 | 10521.3 | P | | | 0.37 | | 0.2 | | | | | |
| BDL177 | 10521.3 | Av | | | 1.22 | | 1.16 | | | | | |
| BDL177 | 10522.2 | P | | | | | | | | | <0.01 | |
| BDL177 | 10522.2 | Av | | | | | | | | | 1.05 | |
| BDL177 | 10524.2 | P | | | 0.16 | | | 0.21 | 0.28 | | | |
| BDL177 | 10524.2 | Av | | | 1.14 | | | 1.14 | 1.17 | | | |
| BDL182 | 10691.2 | P | | | | 0.14 | 0.59 | 0.08 | | | | |
| BDL182 | 10691.2 | Av | | | | 1.11 | 1.12 | 1.2 | | | | |
| BDL182 | 10692.3 | P | | | 0.53 | 0.2 | | | 0.73 | | | |
| BDL182 | 10692.3 | Av | | | 1.16 | 1.15 | | | 1.13 | | | |
| BDL182 | 10693.2 | P | | | | 0.34 | | 0.18 | | 0.67 | | |
| BDL182 | 10693.2 | Av | | | | 1.13 | | 1.24 | | 1.11 | | |
| BDL182 | 10693.3 | P | | | 0.25 | 0.07 | | 0.05 | 0.25 | | | |
| BDL182 | 10693.3 | Av | | | 1.18 | 1.14 | | 1.42 | 1.35 | | | |
| BDL182 | 10693.5 | P | | | | | | 0.15 | 0.05 | | | |
| BDL182 | 10693.5 | Av | | | | | | 1.18 | 1.29 | | | |
| BDL182 | 10691.2 | P | | | | | | | | | 0.02 | 0.01 |
| BDL182 | 10691.2 | Av | | | | | | | | | 1.06 | 1.04 |
| BDL182 | 10691.4 | P | <0.01 | 0.2 | 0.56 | 0.65 | | <0.01 | 0.13 | | | |
| BDL182 | 10691.4 | Av | 1.25 | 1.15 | 1.19 | 1.12 | | 1.48 | 1.29 | | | |
| BDL182 | 10691.8 | P | | | 0.79 | | | 0.84 | | | | |
| BDL182 | 10691.8 | Av | | | 1.14 | | | 1.14 | | | | |
| BDL182 | 10693.2 | P | | | | | | | | | 0.02 | |
| BDL182 | 10693.2 | Av | | | | | | | | | 1.05 | |
| BDL182 | 10693.3 | P | | | | | | 0.85 | | | | |
| BDL182 | 10693.3 | Av | | | | | | 1.13 | | | | |
| BDL183 | 9941.1 | P | | <0.01 | | | 0.26 | | | | | |
| BDL183 | 9941.1 | Av | | 1.09 | | | 1.13 | | | | | |
| BDL183 | 9942.4 | P | | | | | | 0.02 | <0.01 | | | |
| BDL183 | 9942.4 | Av | | | | | | 1.17 | 1.16 | | | |
| BDL183 | 9943.4 | P | | | | 0.21 | 0.15 | | | | | |
| BDL183 | 9943.4 | Av | | | | 1.11 | 1.14 | | | | | |
| BDL183 | 9944.1 | P | 0.05 | <0.01 | 0.09 | 0.01 | 0.3 | <0.01 | 0.02 | | | |
| BDL183 | 9944.1 | Av | 1.04 | 1.1 | 1.19 | 1.15 | 1.13 | 1.31 | 1.21 | | | |

TABLE 25-continued

Results from greenhouse experiments

| Gene | Ev. | Par | 11 | 12 | 13 | 14 | 15 | 16 | 17 | 18 | 19 | 20 |
|---|---|---|---|---|---|---|---|---|---|---|---|---|
| BDL183 | 9941.1 | P | | | | | 0.64 | | | 0.56 | | |
| BDL183 | 9941.1 | Av | | | | | 1.11 | | | 1.16 | | |
| BDL183 | 9942.1 | P | | | 0.12 | 0.31 | 0.46 | 0.02 | | | | |
| BDL183 | 9942.1 | Av | | | 1.13 | 1.19 | 1.12 | 1.26 | | | | |
| BDL186 | 10002.2 | P | | | | 0.01 | <0.01 | | | 0.1 | | |
| BDL186 | 10002.2 | Av | | | | 1.14 | 1.21 | | | 1.12 | | |
| BDL186 | 10004.3 | P | | | | 0.71 | 0.59 | | | | 0.09 | <0.01 |
| BDL186 | 10004.3 | Av | | | | 1.13 | 1.15 | | | | 1.02 | 1.02 |
| BDL186 | 10001.3 | P | | | | | | 0.3 | | | | |
| BDL186 | 10001.3 | Av | | | | | | 1.25 | | | | |
| BDL186 | 10004.6 | P | | | 0.54 | | | | | | | |
| BDL186 | 10004.6 | Av | | | 1.16 | | | | | | | |
| BDL187 | 10502.2 | P | | | 0.38 | | | | | | | |
| BDL187 | 10502.2 | Av | | | 1.12 | | | | | | | |
| BDL187 | 10502.4 | P | | | | | 0.59 | | | | | |
| BDL187 | 10502.4 | Av | | | | | 1.1 | | | | | |
| BDL187 | 10503.1 | P | | | 0.05 | | | | 0.26 | | | |
| BDL187 | 10503.1 | Av | | | 1.26 | | | | 1.15 | | | |
| BDL187 | 10503.3 | P | | | 0.29 | | | | 0.3 | | | |
| BDL187 | 10503.3 | Av | | | 1.25 | | | | 1.14 | | | |
| BDL187 | 10503.5 | P | | | | | | 0.2 | 0.08 | | | |
| BDL187 | 10503.5 | Av | | | | | | 1.36 | 1.25 | | | |
| BDL188 | 10462.4 | P | | | | 0.09 | | | | | | |
| BDL188 | 10462.4 | Av | | | | 1.06 | | | | | | |
| BDL188 | 10462.1 | P | | | 0.02 | 0.11 | 0.44 | 0.25 | 0.29 | | | |
| BDL188 | 10462.1 | Av | | | 1.28 | 1.32 | 1.19 | 1.15 | 1.14 | | | |
| BDL188 | 10462.4 | P | | | | 0.02 | 0.09 | 0.01 | 0.25 | | | |
| BDL188 | 10462.4 | Av | | | | 1.19 | 1.22 | 1.36 | 1.24 | | | |
| BDL188 | 10464.5 | P | | | | | | 0.33 | | | | |
| BDL188 | 10464.5 | Av | | | | | | 1.19 | | | | |
| BDL190 | 10234.1 | P | | | | 0.5 | | | | | | |
| BDL190 | 10234.1 | Av | | | | 1.11 | | | | | | |
| BDL190 | 10234.2 | P | | | | 0.57 | | | | | 0.01 | |
| BDL190 | 10234.2 | Av | | | | 1.1 | | | | | 1.03 | |
| BDL190 | 10231.1 | P | | | | | | 0.21 | | | | |
| BDL190 | 10231.1 | Av | | | | | | 1.13 | | | | |
| BDL190 | 10231.2 | P | | | | | | 0.02 | | | | |
| BDL190 | 10231.2 | Av | | | | | | 1.24 | | | | |
| BDL190 | 10232.2 | P | | | 0.44 | 0.08 | 0.16 | 0.1 | 0.39 | 0.25 | | |
| BDL190 | 10232.2 | Av | | | 1.18 | 1.23 | 1.18 | 1.29 | 1.16 | 1.16 | | |
| BDL190 | 10233.2 | P | | | 0.05 | 0.02 | <0.01 | 0.02 | 0.05 | 0.05 | | 0.04 |
| BDL190 | 10233.2 | Av | | | 1.18 | 1.31 | 1.21 | 1.25 | 1.15 | 1.31 | | 1.02 |
| BDL190 | 10233.4 | P | | | | | 0.02 | 0.45 | 0.5 | <0.01 | | |
| BDL190 | 10233.4 | Av | | | | | 1.2 | 1.16 | 1.12 | 1.16 | | |
| BDL190 | 10234.2 | P | | | | 0.07 | | 0.05 | | | | |
| BDL190 | 10234.2 | Av | | | | 1.17 | | 1.19 | | | | |
| BDL192 | 9921.3 | P | | | | | | 0.38 | | | | |
| BDL192 | 9921.3 | Av | | | | | | 1.13 | | | | |
| BDL192 | 9921.6 | P | | | 0.12 | 0.36 | 0.55 | | | | | |
| BDL192 | 9921.6 | Av | | | 1.15 | 1.13 | 1.11 | | | | | |
| BDL192 | 9922.1 | P | | | 0.11 | 0.12 | | 0.57 | 0.56 | | | |
| BDL192 | 9922.1 | Av | | | 1.18 | 1.11 | | 1.17 | 1.11 | | | |
| BDL192 | 9921.6 | P | | 0.09 | 0.19 | | 0.51 | | | | | |
| BDL192 | 9921.6 | Av | | 1.07 | 1.1 | | 1.13 | | | | | |
| BDL192 | 9922.5 | P | | 0.01 | 0.35 | 0.29 | | | | 0.5 | | |
| BDL192 | 9922.5 | Av | | 1.06 | 1.18 | 1.2 | | | | 1.11 | | |
| BDL193 | 10152.2 | P | 0.05 | 0.23 | | | | 0.05 | 0.14 | | | |
| BDL193 | 10152.2 | Av | 1.04 | 1.1 | | | | 1.17 | 1.11 | | | |
| BDL193 | 10152.3 | P | | | | | | | | | | 0.02 |
| BDL193 | 10152.3 | Av | | | | | | | | | | 1.02 |
| BDL193 | 10153.2 | P | | | | | | 0.32 | | | | |
| BDL193 | 10153.2 | Av | | | | | | 1.1 | | | | |
| BDL193 | 10153.4 | P | | | 0.37 | | 0.29 | | 0.46 | 0.09 | <0.01 | |
| BDL193 | 10153.4 | Av | | | 1.14 | | 1.15 | | 1.1 | 1.09 | 1.02 | |
| BDL193 | 10153.2 | P | | | | 0.42 | | | | | 0.07 | <0.01 |
| BDL193 | 10153.2 | Av | | | | 1.12 | | | | | 1.02 | 1.03 |
| BDL193 | 10153.3 | P | 0.07 | | 0.37 | 0.01 | | 0.2 | 0.22 | 0.09 | | |
| BDL193 | 10153.3 | Av | 1.1 | | 1.15 | 1.27 | | 1.2 | 1.18 | 1.16 | | |
| BDL193 | 10153.4 | P | | | 0.41 | 0.24 | 0.16 | 0.63 | | | | |
| BDL193 | 10153.4 | Av | | | 1.13 | 1.16 | 1.1 | 1.11 | | | | |
| BDL196 | 10243.1 | P | | | 0.65 | 0.77 | | 0.63 | 0.71 | | | |
| BDL196 | 10243.1 | Av | | | 1.2 | 1.11 | | 1.22 | 1.11 | | | |
| BDL201 | 9961.3 | P | 0.22 | 0.04 | 0.18 | 0.29 | 0.43 | | 0.46 | 0.07 | | 0.09 |
| BDL201 | 9961.3 | Av | 1.1 | 1.06 | 1.28 | 1.16 | 1.33 | | 1.12 | 1.25 | | 1.02 |
| BDL220 | 10331.5 | P | | | | | | | | | | <0.01 |
| BDL220 | 10331.5 | Av | | | | | | | | | | 1.05 |

TABLE 25-continued

Results from greenhouse experiments

| Gene | Ev. | Par | 11 | 12 | 13 | 14 | 15 | 16 | 17 | 18 | 19 | 20 |
|---|---|---|---|---|---|---|---|---|---|---|---|---|
| BDL220 | 10331.7 | P | | | | | | | | | | 0.39 |
| BDL220 | 10331.7 | Av | | | | | | | | | | 1.1 |
| BDL220 | 10333.5 | P | | | | | 0.49 | | | | | |
| BDL220 | 10333.5 | Av | | | | | 1.18 | | | | | |
| BDL223 | 10793.3 | P | | | | | 0.1 | | | | | |
| BDL223 | 10793.3 | Av | | | | | 1.1 | | | | | |
| BDL223 | 10793.5 | P | <0.01 | | 0.47 | 0.01 | 0.02 | 0.1 | 0.21 | 0.12 | | 0.08 |
| BDL223 | 10793.5 | Av | 1.08 | | 1.1 | 1.23 | 1.15 | 1.22 | 1.16 | 1.12 | | 1.02 |
| BDL223 | 10793.8 | P | 0.08 | | 0.08 | 0.09 | 0.06 | 0.1 | 0.23 | | | |
| BDL223 | 10793.8 | Av | 1.03 | | 1.28 | 1.2 | 1.11 | 1.21 | 1.1 | | | |
| BDL224 | 10451.7 | P | | | | | | 0.57 | | | | |
| BDL224 | 10451.7 | Av | | | | | | 1.11 | | | | |
| BDL224 | 10453.3 | P | | | | | | | | | | 0.5 |
| BDL224 | 10453.3 | Av | | | | | | | | | | 1.12 |
| BDL225 | 10401.4 | P | 0.07 | | | | | | | | | |
| BDL225 | 10401.4 | Av | 1.04 | | | | | | | | | |
| BDL226 | 10861.2 | P | 0.03 | | | 0.04 | 0.08 | | 0.25 | 0.08 | 0.29 | 0.01 |
| BDL226 | 10861.2 | Av | 1.19 | | 1.17 | 1.14 | | 1.37 | 1.31 | 1.12 | 1.06 | |
| BDL226 | 10864.2 | P | <0.01 | 0.07 | <0.01 | 0.01 | 0.11 | 0.06 | <0.01 | | | |
| BDL226 | 10864.2 | Av | 1.17 | 1.08 | 1.38 | 1.24 | 1.13 | 1.43 | 1.36 | | | |
| BDL227 | 11491.3 | P | | | <0.01 | | 0.5 | 0.37 | | | | |
| BDL227 | 11491.3 | Av | | | 1.23 | | 1.12 | 1.12 | | | | |
| BDL227 | 11492.3 | P | | | 0.04 | <0.01 | 0.06 | 0.03 | 0.04 | 0.35 | | |
| BDL227 | 11492.3 | Av | | | 1.16 | 1.25 | 1.14 | 1.21 | 1.19 | 1.14 | | |
| BDL233 | 10822.1 | P | | | | | | | <0.01 | | | |
| BDL233 | 10822.1 | Av | | | | | | | 1.21 | | | |
| BDL233 | 10825.4 | P | | | | 0.39 | 0.47 | 0.32 | 0.5 | 0.02 | | |
| BDL233 | 10825.4 | Av | | | | 1.32 | 1.29 | 1.27 | 1.18 | 1.12 | | |
| BDL237 | 10893.1 | P | | | 0.07 | | | | | | | |
| BDL237 | 10893.1 | Av | | | 1.17 | | | | | | | |
| BDL237 | 10895.1 | P | | | 0.09 | 0.44 | | 0.16 | 0.26 | | | |
| BDL237 | 10895.1 | Av | | | 1.11 | 1.18 | | 1.22 | 1.1 | | | |
| BDL237 | 10895.2 | P | | | 0.2 | 0.66 | | | | | | |
| BDL237 | 10895.2 | Av | | | 1.13 | 1.12 | | | | | | |
| BDL237 | 10895.3 | P | | | 0.51 | | | 0.36 | 0.64 | | | |
| BDL237 | 10895.3 | Av | | | 1.12 | | | 1.26 | 1.11 | | | |
| BDL237 | 10896.1 | P | | | | 0.11 | | | | 0.52 | | |
| BDL237 | 10896.1 | Av | | | | 1.13 | | | | 1.1 | | |
| BDL238 | 10951.4 | P | | | | 0.09 | | 0.22 | 0.18 | | | |
| BDL238 | 10951.4 | Av | | | | 1.11 | | 1.13 | 1.12 | | | |
| BDL238 | 10952.3 | P | | | | 0.69 | | | | 0.7 | | |
| BDL238 | 10952.3 | Av | | | | 1.1 | | | | 1.1 | | |
| BDL238 | 10954.2 | P | | | 0.08 | <0.01 | <0.01 | 0.11 | <0.01 | | | |
| BDL238 | 10954.2 | Av | | | 1.59 | 1.7 | 1.46 | 1.34 | 1.29 | | | |
| BDL238 | 10954.3 | P | | | 0.67 | | | 0.58 | | | | |
| BDL238 | 10954.3 | Av | | | 1.15 | | | 1.1 | | | | |
| BDL240 | 10802.2 | P | | | 0.05 | 0.04 | <0.01 | <0.01 | 0.08 | 0.05 | | |
| BDL240 | 10802.2 | Av | | | 1.34 | 1.61 | 1.3 | 1.22 | 1.27 | 1.17 | | |
| BDL240 | 10806.2 | P | | | | 0.3 | | | | | | |
| BDL240 | 10806.2 | Av | | | | 1.1 | | | | | | |
| BDL240 | 10806.6 | P | 0.01 | | | | | | | | | 0.09 |
| BDL240 | 10806.6 | Av | 1.06 | | | | | | | | | 1.04 |
| BDL241 | 10873.1 | P | | | <0.01 | 0.52 | 0.1 | 0.09 | 0.06 | | | |
| BDL241 | 10873.1 | Av | | | 1.41 | 1.24 | 1.33 | 1.23 | 1.23 | | | |
| BDL242 | 10731.2 | P | | | 0.05 | 0.45 | 0.62 | 0.49 | 0.45 | | | |
| BDL242 | 10731.2 | Av | | | 1.26 | 1.27 | 1.11 | 1.11 | 1.11 | | | |
| BDL242 | 10731.5 | P | | | 0.05 | | | | | | | |
| BDL242 | 10731.5 | Av | | | 1.13 | | | | | | | |
| BDL242 | 10731.6 | P | | | 0.01 | 0.19 | 0.02 | <0.01 | 0.09 | | 0.03 | |
| BDL242 | 10731.6 | Av | | | 1.46 | 1.43 | 1.37 | 1.29 | 1.21 | | 1.02 | |
| BDL242 | 10731.7 | P | | | 0.04 | | | 0.25 | | | | |
| BDL242 | 10731.7 | Av | | | 1.14 | | | 1.15 | | | | |
| BDL245 | 10813.3 | P | 0.04 | 0.02 | | | | 0.27 | 0.08 | 0.2 | | |
| BDL245 | 10813.3 | Av | 1.07 | 1.08 | | | | 1.14 | 1.2 | 1.15 | | |
| BDL245 | 10816.3 | P | | | | | | | | | | 0.02 |
| BDL245 | 10816.3 | Av | | | | | | | | | | 1.03 |
| BDL245 | 10812.3 | P | | | | | | | | 0.07 | | |
| BDL245 | 10812.3 | Av | | | | | | | | 1.09 | | |
| BDL245 | 10813.3 | P | | | | | | 0.12 | 0.03 | 0.01 | | |
| BDL245 | 10813.3 | Av | | | | | | 1.14 | 1.11 | 1.16 | | |
| BDL247 | 10911.4 | P | | | | | | | | | | 0.01 |
| BDL247 | 10911.4 | Av | | | | | | | | | | 1.03 |
| BDL247 | 10912.6 | P | | | | | | | | | | 0.02 |
| BDL247 | 10912.6 | Av | | | | | | | | | | 1.02 |
| BDL248 | 11051.1 | P | | | | | | | | | 0.04 | |
| BDL248 | 11051.1 | Av | | | | | | | | | 1.03 | |

TABLE 25-continued

Results from greenhouse experiments

| Gene | Ev. | Par | 11 | 12 | 13 | 14 | 15 | 16 | 17 | 18 | 19 | 20 |
|---|---|---|---|---|---|---|---|---|---|---|---|---|
| BDL248 | 11054.1 | P | | | | | | | | | 0.06 | |
| BDL248 | 11054.1 | Av | | | | | | | | | 1.04 | |
| BDL250 | 10841.3 | P | | | 0.05 | 0.23 | 0.45 | 0.05 | 0.01 | 0.21 | | |
| BDL250 | 10841.3 | Av | | | 1.31 | 1.31 | 1.12 | 1.38 | 1.32 | 1.1 | | |
| BDL250 | 10842.3 | P | | | | 0.17 | | | | | | |
| BDL250 | 10842.3 | Av | | | | 1.11 | | | | | | |
| BDL250 | 10846.2 | P | | | | 0.47 | | 0.32 | 0.41 | | | |
| BDL250 | 10846.2 | Av | | | | 1.13 | | 1.2 | 1.11 | | | |
| BDL250 | 10846.3 | P | | | 0.54 | 0.46 | 0.51 | | 0.14 | 0.26 | | |
| BDL250 | 10846.3 | Av | | | 1.15 | 1.3 | 1.22 | | 1.25 | 1.15 | | |
| BDL252 | 10882.1 | P | | | 0.26 | 0.25 | 0.24 | 0.33 | 0.51 | 0.54 | 0.01 | |
| BDL252 | 10882.1 | Av | | | 1.35 | 1.36 | 1.22 | 1.35 | 1.28 | 1.21 | 1.02 | |
| BDL252 | 10882.4 | P | | | 0.49 | | | | | | | |
| BDL252 | 10882.4 | Av | | | 1.14 | | | | | | | |
| BDL48 | 10274.4 | P | 0.04 | | | | 0.01 | 0.06 | 0.01 | 0.13 | | |
| BDL48 | 10274.4 | Av | 1.11 | | | | 1.33 | 1.4 | 1.49 | 1.14 | | |
| BDL48 | 10271.1 | P | | | 0.18 | 0.02 | <0.01 | 0.29 | | 0.18 | 0.02 | 0.06 |
| BDL48 | 10271.1 | Av | | | 1.13 | 1.21 | 1.24 | 1.11 | | 1.22 | 1.02 | 1.02 |
| BDL48 | 10271.5 | P | | | | | | 0.51 | | | | |
| BDL48 | 10271.5 | Av | | | | | | 1.1 | | | | |
| BDL48 | 10274.3 | P | | | 0.01 | <0.01 | <0.01 | <0.01 | <0.01 | <0.01 | | |
| BDL48 | 10274.3 | Av | | | 1.24 | 1.33 | 1.16 | 1.44 | 1.32 | 1.17 | | |
| BDL48 | 10274.4 | P | | | 0.11 | 0.02 | 0.15 | 0.53 | 0.15 | 0.3 | | |
| BDL48 | 10274.4 | Av | | | 1.21 | 1.23 | 1.2 | 1.18 | 1.25 | 1.21 | | |
| BDL48 | 10274.5 | P | | | 0.41 | 0.48 | 0.59 | 0.27 | 0.02 | 0.21 | | |
| BDL48 | 10274.5 | Av | | | 1.12 | 1.23 | 1.12 | 1.24 | 1.2 | 1.23 | | |
| BDL63 | 10381.2 | P | | | | | | 0.48 | | | | |
| BDL63 | 10381.2 | Av | | | | | | 1.29 | | | | |
| BDL63 | 10381.1 | P | 0.04 | 0.1 | 0.21 | 0.23 | 0.04 | 0.19 | 0.01 | <0.01 | | |
| BDL63 | 10381.1 | Av | 1.1 | 1.05 | 1.22 | 1.34 | 1.29 | 1.34 | 1.26 | 1.25 | | |
| BDL63 | 10381.2 | P | | | 0.21 | 0.5 | 0.48 | 0.17 | 0.01 | 0.23 | | |
| BDL63 | 10381.2 | Av | | | 1.21 | 1.28 | 1.25 | 1.26 | 1.22 | 1.21 | | |
| BDL63 | 10384.8 | P | | 0.1 | | 0.04 | <0.01 | 0.33 | 0.14 | <0.01 | | |
| BDL63 | 10384.8 | Av | | 1.05 | | 1.2 | 1.2 | 1.15 | 1.1 | 1.25 | | |
| BDL79 | 11042.1 | P | <0.01 | | | 0.12 | | 0.2 | 0.03 | | | |
| BDL79 | 11042.1 | Av | 1.08 | | | 1.1 | | 1.14 | 1.11 | | | |
| BDL79 | 11044.3 | P | | | | 0.12 | <0.01 | 0.01 | 0.41 | | | |
| BDL79 | 11044.3 | Av | | | | 1.12 | 1.24 | 1.15 | 1.18 | | | |
| BDL81 | 10371.8 | P | | | 0.18 | | | | | | | |
| BDL81 | 10371.8 | Av | | | 1.15 | | | | | | | |
| BDL81 | 10374.1 | P | | | 0.24 | | | | | | | |
| BDL81 | 10374.1 | Av | | | 1.13 | | | | | | | |
| BDL81 | 10371.5 | P | | | | 0.2 | 0.32 | 0.06 | | 0.02 | | |
| BDL81 | 10371.5 | Av | | | | 1.15 | 1.15 | 1.18 | | 1.1 | | |
| BDL81 | 10371.8 | P | | | | 0.72 | 0.62 | 0.68 | 0.57 | 0.49 | | |
| BDL81 | 10371.8 | Av | | | | 1.16 | 1.19 | 1.15 | 1.11 | 1.23 | | |
| BDL81 | 10374.1 | P | | | 0.18 | 0.17 | 0.35 | 0.1 | 0.15 | 0.41 | | |
| BDL81 | 10374.1 | Av | | | 1.41 | 1.41 | 1.35 | 1.3 | 1.35 | 1.26 | | |
| BDL85 | 10411.1 | P | | | 0.16 | 0.34 | 0.26 | 0.23 | 0.62 | <0.01 | | |
| BDL85 | 10411.1 | Av | | | 1.29 | 1.3 | 1.28 | 1.32 | 1.12 | 1.1 | | |
| BDL85 | 10414.1 | P | | | | | | | | | 0.07 | |
| BDL85 | 10414.1 | Av | | | | | | | | | 1.02 | |
| BDL85 | 10414.2 | P | | | 0.71 | | | | | | | |
| BDL85 | 10414.2 | Av | | | 1.1 | | | | | | | |

Table 25. Results of the greenhouse experiments. Provided are the measured values of each parameter [parameters (Par.) 11-20 according to the parameters described in Table 23 above] in plants expressing the indicated polynucleotides.
"Ev" = event;
"P" = P-value;
"Av" = ratio between the averages of event and control.
Note that when the average ratio is higher than "1" the effect of exogenous expression of the gene is an increase of the desired trait;

TABLE 26

Results from greenhouse experiments

| Gene | Ev. | Par | 21 | 22 | 23 | 24 | 25 | 26 | 27 | 28 | 29 | 30 |
|---|---|---|---|---|---|---|---|---|---|---|---|---|
| BDL102 | 10471.1 | P | | 0.18 | 0.42 | | 0.39 | | 0.46 | | 0.46 | |
| BDL102 | 10471.1 | Av | | 1.15 | 1.82 | | 1.16 | | 1.13 | | 1.13 | |
| BDL102 | 10471.3 | P | | | 0.48 | | | | | | | |
| BDL102 | 10471.3 | Av | | | 1.38 | | | | | | | |
| BDL102 | 10472.1 | P | | 0.01 | 0.54 | | 0.17 | | 0.22 | | 0.22 | 0.43 |
| BDL102 | 10472.1 | Av | | 1.26 | 2.05 | | 1.28 | | 1.24 | | 1.24 | 1.11 |

TABLE 26-continued

Results from greenhouse experiments

| Gene | Ev. | Par | 21 | 22 | 23 | 24 | 25 | 26 | 27 | 28 | 29 | 30 |
|---|---|---|---|---|---|---|---|---|---|---|---|---|
| BDL102 | 10474.1 | P |  | 0.06 |  | 0.29 | 0.01 |  | 0.02 | 0.17 | 0.02 | 0.1 |
| BDL102 | 10474.1 | Av |  | 1.15 |  | 1.43 | 1.54 |  | 1.48 | 1.14 | 1.48 | 1.29 |
| BDL102 | 10474.2 | P |  | 0.03 |  |  | 0.1 |  | 0.18 |  | 0.18 |  |
| BDL102 | 10474.2 | Av |  | 1.14 |  |  | 1.32 |  | 1.25 |  | 1.25 |  |
| BDL102 | 10474.6 | P | 0.02 |  | 0.55 |  |  |  |  |  |  |  |
| BDL102 | 10474.6 | Av | 1.02 |  | 1.76 |  |  |  |  |  |  |  |
| BDL117 | 10071.2 | P |  |  |  |  |  | 0.24 |  |  |  |  |
| BDL117 | 10071.2 | Av |  |  |  |  |  | 1.15 |  |  |  |  |
| BDL117 | 10073.2 | P |  | 0.46 | 0.01 | 0.01 |  |  |  |  |  |  |
| BDL117 | 10073.2 | Av |  | 1.19 | 1.2 | 1.14 |  |  |  |  |  |  |
| BDL117 | 10074.1 | P |  |  | 0.53 |  | 0.08 | 0.08 | 0.03 | 0.11 | 0.02 |  |
| BDL117 | 10074.1 | Av |  |  | 1.13 |  | 1.28 | 1.22 | 1.42 | 1.18 | 1.44 |  |
| BDL117 | 10074.4 | P |  |  |  |  | 0.33 |  | 0.19 |  | 0.14 |  |
| BDL117 | 10074.4 | Av |  |  |  |  | 1.16 |  | 1.24 |  | 1.26 |  |
| BDL117 | 10071.2 | P |  |  |  |  |  | 0.21 |  |  |  |  |
| BDL117 | 10071.2 | Av |  |  |  |  |  | 1.16 |  |  |  |  |
| BDL117 | 10073.1 | P |  |  |  |  | 0.35 |  | 0.43 |  |  | 0.47 |
| BDL117 | 10073.1 | Av |  |  |  |  | 1.17 |  | 1.14 |  |  | 1.16 |
| BDL117 | 10073.2 | P |  |  |  |  | 0.09 |  | 0.16 | 0.08 | 0.16 |  |
| BDL117 | 10073.2 | Av |  |  |  |  | 1.3 |  | 1.25 | 1.2 | 1.25 |  |
| BDL117 | 10074.1 | P |  |  |  |  | 0.16 | 0.29 | 0.08 | 0.1 | 0.08 |  |
| BDL117 | 10074.1 | Av |  |  |  |  | 1.24 | 1.12 | 1.31 | 1.17 | 1.31 |  |
| BDL117 | 10074.4 | P |  | 0.71 |  |  | 0.54 |  | 0.43 | 0.27 | 0.43 |  |
| BDL117 | 10074.4 | Av |  | 1.14 |  |  | 1.1 |  | 1.13 | 1.1 | 1.13 |  |
| BDL138 | 9811.1 | P |  |  |  | 0.15 |  |  |  |  |  |  |
| BDL138 | 9811.1 | Av |  |  |  | 1.13 |  |  |  |  |  |  |
| BDL138 | 9811.4 | P |  | 0.41 | 0.03 | <0.01 |  |  |  |  |  |  |
| BDL138 | 9811.4 | Av |  | 1.21 | 1.07 | 1.26 |  |  |  |  |  |  |
| BDL138 | 9812.1 | P |  | <0.01 | 0.42 | <0.01 |  |  |  |  |  |  |
| BDL138 | 9812.1 | Av |  | 1.14 | 1.16 | 1.2 |  |  |  |  |  |  |
| BDL138 | 9812.3 | P | 0.07 |  |  |  |  |  |  |  |  |  |
| BDL138 | 9812.3 | Av | 1.02 |  |  |  |  |  |  |  |  |  |
| BDL138 | 9813.1 | P |  |  |  |  |  | 0.28 |  |  |  |  |
| BDL138 | 9813.1 | Av |  |  |  |  |  | 1.13 |  |  |  |  |
| BDL138 | 9813.3 | P |  | 0.06 | 0.55 |  |  |  |  |  |  |  |
| BDL138 | 9813.3 | Av |  | 1.3 | 1.12 |  |  |  |  |  |  |  |
| BDL138 | 9811.1 | P | 0.04 |  |  |  |  |  |  |  |  |  |
| BDL138 | 9811.1 | Av | 1.02 |  |  |  |  |  |  |  |  |  |
| BDL138 | 9813.1 | P |  | 0.56 |  |  |  | 0.1 |  |  |  |  |
| BDL138 | 9813.1 | Av |  | 1.19 |  |  |  | 1.18 |  |  |  |  |
| BDL138 | 9813.4 | P |  | 0.75 |  |  |  |  |  |  |  |  |
| BDL138 | 9813.4 | Av |  | 1.14 |  |  |  |  |  |  |  |  |
| BDL138 | 9811.4 | P |  | 0.29 |  |  |  |  |  |  |  |  |
| BDL138 | 9811.4 | Av |  | 1.1 |  |  |  |  |  |  |  |  |
| BDL138 | 9812.1 | P |  | 0.39 |  |  |  |  |  |  |  |  |
| BDL138 | 9812.1 | Av |  | 1.61 |  |  |  |  |  |  |  |  |
| BDL138 | 9813.1 | P |  | 0.14 |  |  |  | 0.29 |  |  |  |  |
| BDL138 | 9813.1 | Av |  | 1.33 |  |  |  | 1.12 |  |  |  |  |
| BDL138 | 9813.3 | P |  | 0.36 | 0.09 |  |  |  |  |  |  |  |
| BDL138 | 9813.3 | Av |  | 1.87 | 1.07 |  |  |  |  |  |  |  |
| BDL140 | 10421.3 | P |  | 0.84 |  | 0.37 |  |  |  |  |  |  |
| BDL140 | 10421.3 | Av |  | 1.16 |  | 1.18 |  |  |  |  |  |  |
| BDL140 | 10424.3 | P |  |  | 0.47 |  |  |  |  |  |  |  |
| BDL140 | 10424.3 | Av |  |  | 1.18 |  |  |  |  |  |  |  |
| BDL140 | 10421.2 | P |  | 0.02 | 0.22 |  |  |  |  |  |  |  |
| BDL140 | 10421.2 | Av |  | 1.14 | 1.12 |  |  |  |  |  |  |  |
| BDL140 | 10423.1 | P | 0.08 |  |  |  |  |  |  |  |  |  |
| BDL140 | 10423.1 | Av | 1.03 |  |  |  |  |  |  |  |  |  |
| BDL147 | 10301.3 | P |  | 0.54 |  |  |  |  |  |  |  |  |
| BDL147 | 10301.3 | Av |  | 1.17 |  |  |  |  |  |  |  |  |
| BDL147 | 10303.1 | P | 0.01 |  |  |  | 0.53 |  | 0.32 |  | 0.32 |  |
| BDL147 | 10303.1 | Av | 1.02 |  |  |  | 1.11 |  | 1.18 |  | 1.18 |  |
| BDL147 | 10303.6 | P | 0.07 |  |  |  |  |  |  |  |  |  |
| BDL147 | 10303.6 | Av | 1.02 |  |  |  |  |  |  |  |  |  |
| BDL147 | 10304.2 | P | <0.01 |  |  |  | 0.55 |  |  |  |  |  |
| BDL147 | 10304.2 | Av | 1.04 |  |  |  | 1.1 |  |  |  |  |  |
| BDL147 | 10301.5 | P |  | 0.36 |  |  |  |  |  |  |  |  |
| BDL147 | 10301.5 | Av |  | 1.15 |  |  |  |  |  |  |  |  |
| BDL147 | 10301.6 | P |  | 0.02 |  |  |  |  |  |  |  |  |
| BDL147 | 10301.6 | Av |  | 1.14 |  |  |  |  |  |  |  |  |
| BDL147 | 10303.1 | P |  | 0.01 |  |  |  |  |  |  |  |  |
| BDL147 | 10303.1 | Av |  | 1.29 |  |  |  |  |  |  |  |  |
| BDL147 | 10303.5 | P |  | 0.02 |  | 0.43 | 0.31 |  |  |  | 0.08 |  |
| BDL147 | 10303.5 | Av |  | 1.17 |  | 1.17 | 1.12 |  |  |  | 1.09 |  |
| BDL147 | 10304.2 | P |  |  |  |  | 0.04 | 0.36 |  | 0.36 |  |  |
| BDL147 | 10304.2 | Av |  |  |  |  | 1.23 | 1.14 |  | 1.14 |  |  |

TABLE 26-continued

Results from greenhouse experiments

| Gene | Ev. | Par | 21 | 22 | 23 | 24 | 25 | 26 | 27 | 28 | 29 | 30 |
|---|---|---|---|---|---|---|---|---|---|---|---|---|
| BDL149 | 9823.1 | P | | 0.04 | 0.05 | 0.11 | | | | | | |
| BDL149 | 9823.1 | Av | | 1.17 | 1.19 | 1.17 | | | | | | |
| BDL149 | 9823.3 | P | | <0.01 | <0.01 | 0.23 | | 0.34 | 0.42 | | | |
| BDL149 | 9823.3 | Av | | 1.17 | 1.14 | 1.12 | | 1.12 | 1.14 | | | |
| BDL149 | 9824.3 | P | | | | | | 0.34 | | | | |
| BDL149 | 9824.3 | Av | | | | | | 1.11 | | | | |
| BDL149 | 9824.4 | P | | | | | 0.28 | | 0.11 | | 0.08 | <0.01 |
| BDL149 | 9824.4 | Av | | | | | 1.17 | | 1.28 | | 1.3 | 1.15 |
| BDL149 | 9823.3 | P | | | | | 0.48 | | 0.48 | | 0.48 | 0.1 |
| BDL149 | 9823.3 | Av | | | | | 1.12 | | 1.12 | | 1.12 | 1.08 |
| BDL149 | 9824.3 | P | | | | | | 0.27 | | | | |
| BDL149 | 9824.3 | Av | | | | | | 1.14 | | | | |
| BDL152 | 10431.1 | P | 0.01 | | | | | | | | | |
| BDL152 | 10431.1 | Av | 1.02 | | | | | | | | | |
| BDL152 | 10432.5 | P | | | | | 0.37 | | | | | |
| BDL152 | 10432.5 | Av | | | | | 1.17 | | | | | |
| BDL152 | 10434.1 | P | | | 0.05 | | | | | | | |
| BDL152 | 10434.1 | Av | | | 1.16 | | | | | | | |
| BDL152 | 10434.4 | P | | 0.58 | 0.27 | | 0.3 | | 0.32 | 0.31 | 0.32 | 0.56 |
| BDL152 | 10434.4 | Av | | 1.14 | 1.17 | | 1.19 | | 1.19 | 1.15 | 1.19 | 1.1 |
| BDL152 | 10431.1 | P | | 0.43 | 0.58 | | | | | | | |
| BDL152 | 10431.1 | Av | | 1.18 | 1.1 | | | | | | | |
| BDL152 | 10431.3 | P | | | | 0.02 | | | | | | |
| BDL152 | 10431.3 | Av | | | | 1.18 | | | | | | |
| BDL152 | 10434.1 | P | | | 0.42 | | | | | | | |
| BDL152 | 10434.1 | Av | | | 1.1 | | | | | | | |
| BDL152 | 10434.4 | P | 0.09 | | | | | | | | | |
| BDL152 | 10434.4 | Av | 1.03 | | | | | | | | | |
| BDL153 | 10141.3 | P | 0.09 | | | | 0.12 | | 0.07 | 0.23 | 0.05 | |
| BDL153 | 10141.3 | Av | 1.02 | | | | 1.25 | | 1.33 | 1.13 | 1.35 | |
| BDL153 | 10142.2 | P | | | | | 0.04 | 0.09 | 0.01 | 0.11 | <0.01 | |
| BDL153 | 10142.2 | Av | | | | | 1.37 | 1.22 | 1.56 | 1.2 | 1.58 | |
| BDL153 | 10143.1 | P | | | | | 0.45 | | 0.48 | | 0.4 | |
| BDL153 | 10143.1 | Av | | | | | 1.12 | | 1.12 | | 1.14 | |
| BDL153 | 10144.1 | P | | | | | 0.52 | 0.25 | 0.53 | | 0.45 | |
| BDL153 | 10144.1 | Av | | | | | 1.1 | 1.13 | 1.11 | | 1.12 | |
| BDL153 | 10141.3 | P | | 0.22 | 0.67 | | 0.48 | | 0.39 | | 0.39 | |
| BDL153 | 10141.3 | Av | | 1.28 | 1.12 | | 1.11 | | 1.14 | | 1.14 | |
| BDL153 | 10142.2 | P | | 0.05 | <0.01 | 0.63 | 0.11 | | 0.06 | 0.04 | 0.06 | |
| BDL153 | 10142.2 | Av | | 1.36 | 1.2 | 1.1 | 1.26 | | 1.33 | 1.18 | 1.33 | |
| BDL153 | 10142.3 | P | | | | | 0.26 | | 0.29 | 0.2 | 0.29 | |
| BDL153 | 10142.3 | Av | | | | | 1.19 | | 1.18 | 1.12 | 1.18 | |
| BDL153 | 10143.1 | P | | 0.09 | | | | | | | | 0.25 |
| BDL153 | 10143.1 | Av | | 1.09 | | | | | | | | 1.11 |
| BDL153 | 10143.2 | P | | 0.05 | | | 0.47 | 0.22 | 0.36 | 0.23 | 0.36 | 0.23 |
| BDL153 | 10143.2 | Av | | 1.11 | | | 1.11 | 1.15 | 1.15 | 1.1 | 1.15 | 1.13 |
| BDL153 | 10144.1 | P | | | | | 0.28 | | 0.26 | 0.06 | 0.26 | |
| BDL153 | 10144.1 | Av | | | | | 1.17 | | 1.18 | 1.17 | 1.18 | |
| BDL154 | 10703.1 | P | | 0.11 | 0.64 | 0.67 | | | | | | |
| BDL154 | 10703.1 | Av | | 1.1 | 1.2 | 1.27 | | | | | | |
| BDL154 | 10703.5 | P | | 0.37 | 0.44 | 0.66 | | | | | | |
| BDL154 | 10703.5 | Av | | 1.18 | 1.26 | 1.13 | | | | | | |
| BDL154 | 10703.6 | P | | 0.25 | 0.59 | 0.59 | | | | | | |
| BDL154 | 10703.6 | Av | | 1.28 | 1.47 | 1.29 | | | | | | |
| BDL154 | 10703.8 | P | | 0.29 | | | 0.58 | | 0.58 | | 0.58 | |
| BDL154 | 10703.8 | Av | | 1.17 | | | 1.1 | | 1.1 | | 1.1 | |
| BDL155 | 9991.3 | P | | | | 0.65 | | | | | | |
| BDL155 | 9991.3 | Av | | | | 1.11 | | | | | | |
| BDL155 | 9991.5 | P | | | 0.5 | | 0.34 | | 0.57 | 0.4 | 0.57 | 0.32 |
| BDL155 | 9991.5 | Av | | | 1.23 | | 1.17 | | 1.11 | 1.12 | 1.11 | 1.22 |
| BDL155 | 9991.9 | P | | | 0.39 | | | | | | | |
| BDL155 | 9991.9 | Av | | | 1.22 | | | | | | | |
| BDL155 | 9994.3 | P | | | 0.49 | 0.56 | 0.4 | | 0.31 | 0.49 | 0.31 | |
| BDL155 | 9994.3 | Av | | | 1.1 | 1.14 | 1.15 | | 1.19 | 1.1 | 1.19 | |
| BDL155 | 9994.5 | P | | | | | | 0.41 | | | | |
| BDL155 | 9994.5 | Av | | | | | | 1.14 | | | | |
| BDL157 | 9911.3 | P | | 0.25 | 0.14 | | | | | | | |
| BDL157 | 9911.3 | Av | | 1.54 | 1.11 | | | | | | | |
| BDL157 | 9911.4 | P | | <0.01 | | | | | | | | |
| BDL157 | 9911.4 | Av | | 1.26 | | | | | | | | |
| BDL157 | 9914.2 | P | | 0.37 | | | | | | | | |
| BDL157 | 9914.2 | Av | | 1.23 | | | | | | | | |
| BDL157 | 9911.3 | P | | 0.08 | 0.28 | | | | | | | |
| BDL157 | 9911.3 | Av | | 1.15 | 1.25 | | | | | | | |
| BDL157 | 9911.4 | P | | 0.46 | | | | | | | | |
| BDL157 | 9911.4 | Av | | 1.23 | | | | | | | | |

TABLE 26-continued

Results from greenhouse experiments

| Gene | Ev. | Par | 21 | 22 | 23 | 24 | 25 | 26 | 27 | 28 | 29 | 30 |
|---|---|---|---|---|---|---|---|---|---|---|---|---|
| BDL157 | 9913.3 | P | | 0.37 | | | | | | | | |
| BDL157 | 9913.3 | Av | | 1.21 | | | | | | | | |
| BDL157 | 9914.2 | P | | | | | | | | | | 0.45 |
| BDL157 | 9914.2 | Av | | | | | | | | | | 1.16 |
| BDL160 | 10011.5 | P | | 0.34 | | 0.54 | 0.35 | | | | | |
| BDL160 | 10011.5 | Av | | 1.59 | | 1.26 | 1.15 | | | | | |
| BDL160 | 10011.6 | P | | 0.03 | 0.61 | 0.67 | | | | | | |
| BDL160 | 10011.6 | Av | | 1.15 | 1.23 | 1.16 | | | | | | |
| BDL160 | 10011.7 | P | | 0.02 | | | | | | | | |
| BDL160 | 10011.7 | Av | | 1.16 | | | | | | | | |
| BDL160 | 10013.1 | P | | 0.01 | | 0.41 | | | | | | |
| BDL160 | 10013.1 | Av | | 1.32 | | 1.27 | | | | | | |
| BDL160 | 10015.1 | P | | 0.09 | | 0.09 | | | | | | |
| BDL160 | 10015.1 | Av | | 1.1 | | 1.14 | | | | | | |
| BDL162 | 10491.1 | P | | 0.42 | | | | | | | | |
| BDL162 | 10491.1 | Av | | 1.44 | | | | | | | | |
| BDL162 | 10492.2 | P | | | | | 0.04 | | 0.09 | 0.27 | 0.09 | 0.05 |
| BDL162 | 10492.2 | Av | | | | | 1.4 | | 1.34 | 1.17 | 1.34 | 1.44 |
| BDL162 | 10492.4 | P | | 0.37 | 0.39 | | | 0.55 | | | | |
| BDL162 | 10492.4 | Av | | 1.83 | 1.25 | | | 1.11 | | | | |
| BDL162 | 10494.1 | P | | | 0.63 | | | | | | | |
| BDL162 | 10494.1 | Av | | | 1.13 | | | | | | | |
| BDL167 | 10042.3 | P | | 0.19 | | | | | | | | |
| BDL167 | 10042.3 | Av | | 1.21 | | | | | | | | |
| BDL167 | 10042.3 | P | | | | | | 0.24 | | | | |
| BDL167 | 10042.3 | Av | | | | | | 1.15 | | | | |
| BDL167 | 10043.2 | P | | 0.13 | | | | | | | | 0.6 |
| BDL167 | 10043.2 | Av | | 1.13 | | | | | | | | 1.14 |
| BDL167 | 10043.3 | P | | | | | 0.44 | | | | | 0.27 |
| BDL167 | 10043.3 | Av | | | | | 1.12 | | | | | 1.12 |
| BDL167 | 10043.4 | P | | 0.05 | | 0.33 | | | | | | 0.14 |
| BDL167 | 10043.4 | Av | | 1.16 | | 1.12 | | | | | | 1.46 |
| BDL167 | 10044.2 | P | | 0.2 | | | 0.27 | | 0.2 | | 0.2 | 0.24 |
| BDL167 | 10044.2 | Av | | 1.18 | | | 1.18 | | 1.21 | | 1.21 | 1.19 |
| BDL168 | 9881.3 | P | | | | | 0.01 | 0.01 | 0.04 | 0.01 | | |
| BDL168 | 9881.3 | Av | | | | | 1.44 | 1.48 | 1.23 | 1.5 | | |
| BDL168 | 9881.4 | P | | | 0.36 | | 0.06 | 0.05 | 0.07 | 0.11 | 0.05 | |
| BDL168 | 9881.4 | Av | | | 1.14 | | 1.31 | 1.24 | 1.33 | 1.18 | 1.35 | |
| BDL168 | 9882.1 | P | | | | | | | | | 0.51 | |
| BDL168 | 9882.1 | Av | | | | | | | | | 1.11 | |
| BDL168 | 9882.3 | P | | | | | 0.08 | | 0.09 | 0.16 | 0.07 | |
| BDL168 | 9882.3 | Av | | | | | 1.31 | | 1.33 | 1.17 | 1.35 | |
| BDL168 | 9884.4 | P | <0.01 | | | | 0.32 | 0.46 | 0.2 | 0.39 | | |
| BDL168 | 9884.4 | Av | 1.03 | | | | 1.17 | 1.14 | 1.16 | 1.16 | | |
| BDL168 | 9881.3 | P | | | 0.66 | | | | | | | <0.01 |
| BDL168 | 9881.3 | Av | | | 1.1 | | | | | | | 1.19 |
| BDL168 | 9881.4 | P | | 0.12 | | | 0.44 | | 0.34 | 0.14 | 0.34 | |
| BDL168 | 9881.4 | Av | | 1.17 | | | 1.13 | | 1.16 | 1.13 | 1.16 | |
| BDL168 | 9882.1 | P | | | | | 0.53 | | 0.39 | | | 0.58 |
| BDL168 | 9882.1 | Av | | | | | 1.1 | | 1.14 | | | 1.13 |
| BDL168 | 9882.3 | P | | 0.01 | 0.42 | | | 0.35 | | | | 0.18 |
| BDL168 | 9882.3 | Av | | 1.19 | 1.1 | | | 1.12 | | | | 1.2 |
| BDL168 | 9883.3 | P | | | 0.06 | | | | | | | |
| BDL168 | 9883.3 | Av | | | 1.09 | | | | | | | |
| BDL168 | 9884.1 | P | | | | | | | | 0.07 | | |
| BDL168 | 9884.1 | Av | | | | | | | | 1.17 | | |
| BDL169 | 10743.4 | P | | | | | 0.54 | | 0.37 | | 0.65 | |
| BDL169 | 10743.4 | Av | | | | | 1.11 | | 1.18 | | 1.1 | |
| BDL169 | 10744.1 | P | | | 0.28 | | | 0.3 | | | | |
| BDL169 | 10744.1 | Av | | | 1.12 | | | 1.13 | | | | |
| BDL169 | 10747.1 | P | | 0.6 | 0.53 | | | | | | | |
| BDL169 | 10747.1 | Av | | 1.12 | 1.17 | | | | | | | |
| BDL169 | 10747.5 | P | | | | | | | 0.61 | | 0.44 | |
| BDL169 | 10747.5 | Av | | | | | | | 1.1 | | 1.16 | |
| BDL169 | 10741.3 | P | | 0.73 | | | | | | | | |
| BDL169 | 10741.3 | Av | | 1.1 | | | | | | | | |
| BDL169 | 10744.2 | P | | | | | 0.04 | | 0.05 | 0.07 | 0.05 | 0.84 |
| BDL169 | 10744.2 | Av | | | | | 1.43 | | 1.41 | 1.19 | 1.41 | 1.1 |
| BDL169 | 10747.1 | P | | | 0.65 | 0.43 | 0.35 | | 0.43 | | 0.43 | |
| BDL169 | 10747.1 | Av | | | 1.21 | 1.24 | 1.18 | | 1.15 | | 1.15 | |
| BDL169 | 10747.3 | P | | | | 0.4 | | | | | | |
| BDL169 | 10747.3 | Av | | | | 2.16 | | | | | | |
| BDL169 | 10747.5 | P | | | | | 0.16 | | 0.53 | | 0.53 | |
| BDL169 | 10747.5 | Av | | | | | 1.27 | | 1.11 | | 1.11 | |
| BDL171 | 10661.2 | P | | | | | 0.3 | | 0.31 | 0.54 | 0.31 | 0.34 |
| BDL171 | 10661.2 | Av | | | | | 1.19 | | 1.21 | 1.1 | 1.21 | 1.3 |

TABLE 26-continued

Results from greenhouse experiments

| Gene | Ev. | Par | 21 | 22 | 23 | 24 | 25 | 26 | 27 | 28 | 29 | 30 |
|---|---|---|---|---|---|---|---|---|---|---|---|---|
| BDL171 | 10661.5 | P | | | 0.36 | | | | | | | |
| BDL171 | 10661.5 | Av | | | 1.13 | | | | | | | |
| BDL171 | 10664.1 | P | | | 0.02 | | 0.07 | | 0.03 | 0.28 | 0.03 | 0.67 |
| BDL171 | 10664.1 | Av | | | 1.19 | | 1.39 | | 1.48 | 1.17 | 1.48 | 1.22 |
| BDL171 | 10664.3 | P | | | | | 0.34 | 0.08 | 0.46 | 0.08 | 0.61 | |
| BDL171 | 10664.3 | Av | | | | | 1.17 | 1.36 | 1.11 | 1.36 | 1.25 | |
| BDL171 | 10662.2 | P | | 0.09 | 0.07 | | | | | | | |
| BDL171 | 10662.2 | Av | | 1.45 | 1.45 | | | | | | | |
| BDL171 | 10662.3 | P | | | 0.42 | | 0.07 | | 0.11 | 0.21 | 0.07 | 0.6 |
| BDL171 | 10662.3 | Av | | | 1.2 | | 1.33 | | 1.32 | 1.16 | 1.4 | 1.15 |
| BDL171 | 10663.3 | P | | 0.22 | 0.01 | 0.56 | | | | | | |
| BDL171 | 10663.3 | Av | | 1.19 | 1.51 | 1.14 | | | | | | |
| BDL171 | 10664.1 | P | | | | | | | | | 0.68 | |
| BDL171 | 10664.1 | Av | | | | | | | | | 1.1 | |
| BDL171 | 10664.3 | P | 0.09 | | 0.07 | | | | 0.48 | | 0.34 | |
| BDL171 | 10664.3 | Av | 1.02 | | 1.22 | | | | 1.14 | | 1.21 | |
| BDL173 | 9952.1 | P | | | 0.18 | | 0.39 | 0.22 | 0.51 | | 0.44 | |
| BDL173 | 9952.1 | Av | | | 1.13 | | 1.14 | 1.15 | 1.12 | | 1.13 | |
| BDL173 | 9954.2 | P | | | | 0.09 | | 0.35 | | | | |
| BDL173 | 9954.2 | Av | | | | 1.08 | | 1.11 | | | | |
| BDL173 | 9953.4 | P | 0.03 | | | | | | | | | 0.23 |
| BDL173 | 9953.4 | Av | 1.02 | | | | | | | | | 1.3 |
| BDL173 | 9954.2 | P | 0.02 | | | | | | | | | 0.1 |
| BDL173 | 9954.2 | Av | 1.02 | | | | | | | | | 1.11 |
| BDL176 | 9891.2 | P | | 0.6 | 0.58 | | | | | | | |
| BDL176 | 9891.2 | Av | | 1.24 | 1.19 | | | | | | | |
| BDL176 | 9892.3 | P | | 0.38 | | | | | | | | |
| BDL176 | 9892.3 | Av | | 1.89 | | | | | | | | |
| BDL176 | 9893.2 | P | | 0.73 | | | | | | | | |
| BDL176 | 9893.2 | Av | | 1.11 | | | | | | | | |
| BDL176 | 9893.3 | P | 0.01 | | | | | | | | | 0.37 |
| BDL176 | 9893.3 | Av | 1.02 | | | | | | | | | 1.12 |
| BDL177 | 10521.3 | P | | | | | 0.41 | | | 0.53 | | |
| BDL177 | 10521.3 | Av | | | | | 1.15 | | | 1.1 | | |
| BDL177 | 10522.2 | P | | 0.44 | | | | | | | | |
| BDL177 | 10522.2 | Av | | 1.19 | | | | | | | | |
| BDL182 | 10691.2 | P | | | 0.45 | | 0.35 | | 0.57 | 0.52 | 0.57 | |
| BDL182 | 10691.2 | Av | | | 1.11 | | 1.17 | | 1.11 | 1.1 | 1.11 | |
| BDL182 | 10693.2 | P | | 0.12 | | | | | | | | |
| BDL182 | 10693.2 | Av | | 1.28 | | | | | | | | |
| BDL182 | 10693.3 | P | | | | | | | 0.55 | | 0.55 | |
| BDL182 | 10693.3 | Av | | | | | | | 1.11 | | 1.11 | |
| BDL182 | 10693.5 | P | | | 0.01 | 0.07 | | | | | | |
| BDL182 | 10693.5 | Av | | | 1.28 | 1.08 | | | | | | |
| BDL182 | 10691.2 | P | | | | 0.58 | | | | | | |
| BDL182 | 10691.2 | Av | | | | 1.12 | | | | | | |
| BDL182 | 10691.4 | P | 0.09 | | 0.29 | | | 0.11 | | | | |
| BDL182 | 10691.4 | Av | 1.02 | | 1.27 | | | 1.2 | | | | |
| BDL182 | 10691.8 | P | | | 0.61 | | | | | | | |
| BDL182 | 10691.8 | Av | | | 1.11 | | | | | | | |
| BDL182 | 10693.2 | P | | | 0.38 | 0.57 | | 0.37 | | | | |
| BDL182 | 10693.2 | Av | | | 1.1 | 1.13 | | 1.12 | | | | |
| BDL182 | 10693.3 | P | | 0.69 | 0.43 | 0.46 | | | | | | |
| BDL182 | 10693.3 | Av | | 1.25 | 1.59 | 1.25 | | | | | | |
| BDL183 | 9941.1 | P | | | | | 0.37 | 0.25 | 0.5 | | 0.42 | |
| BDL183 | 9941.1 | Av | | | | | 1.14 | 1.14 | 1.12 | | 1.13 | |
| BDL183 | 9942.1 | P | | | | | | | | | 0.55 | |
| BDL183 | 9942.1 | Av | | | | | | | | | 1.12 | |
| BDL183 | 9942.4 | P | | 0.22 | 0.09 | 0.01 | | 0.07 | | | 0.53 | |
| BDL183 | 9942.4 | Av | | 1.24 | 1.17 | 1.13 | | 1.21 | | | 1.11 | |
| BDL183 | 9943.4 | P | | | | | 0.31 | | 0.53 | 0.37 | | |
| BDL183 | 9943.4 | Av | | | | | 1.16 | | 1.11 | 1.1 | | |
| BDL183 | 9944.1 | P | | | | | 0.46 | | 0.23 | | 0.18 | |
| BDL183 | 9944.1 | Av | | | | | 1.12 | | 1.21 | | 1.23 | |
| BDL183 | 9944.4 | P | <0.01 | | | | | | | | | |
| BDL183 | 9944.4 | Av | 1.03 | | | | | | | | | |
| BDL183 | 9941.1 | P | | | | | 0.38 | | 0.42 | 0.21 | 0.42 | |
| BDL183 | 9941.1 | Av | | | | | 1.15 | | 1.13 | 1.13 | 1.13 | |
| BDL183 | 9942.1 | P | | 0.17 | | | 0.48 | | 0.42 | | 0.42 | |
| BDL183 | 9942.1 | Av | | 1.15 | | | 1.11 | | 1.13 | | 1.13 | |
| BDL183 | 9942.4 | P | | 0.02 | 0.21 | | | | | | | |
| BDL183 | 9942.4 | Av | | 1.16 | 1.13 | | | | | | | |
| BDL183 | 9943.4 | P | | 0.35 | | | | 0.33 | | | 0.12 | |
| BDL183 | 9943.4 | Av | | 1.24 | | | | 1.13 | | | 1.16 | |
| BDL183 | 9944.2 | P | | 0.59 | 0.5 | | | | | | | |
| BDL183 | 9944.2 | Av | | 1.12 | 1.14 | | | | | | | |

TABLE 26-continued

Results from greenhouse experiments

| Gene | Ev. | Par | 21 | 22 | 23 | 24 | 25 | 26 | 27 | 28 | 29 | 30 |
|---|---|---|---|---|---|---|---|---|---|---|---|---|
| BDL186 | 10002.2 | P | | | | | 0.15 | 0.23 | 0.14 | 0.24 | 0.1 | |
| BDL186 | 10002.2 | Av | | | | | 1.23 | 1.14 | 1.26 | 1.13 | 1.28 | |
| BDL186 | 10004.3 | P | | | | | 0.32 | | 0.39 | 0.2 | 0.33 | |
| BDL186 | 10004.3 | Av | | | | | 1.16 | | 1.16 | 1.16 | 1.18 | |
| BDL186 | 10001.3 | P | | | 0.46 | | | | | | | |
| BDL186 | 10001.3 | Av | | | 1.1 | | | | | | | |
| BDL186 | 10004.3 | P | | 0.55 | | | | | | | | |
| BDL186 | 10004.3 | Av | | 1.15 | | | | | | | | |
| BDL187 | 10502.2 | P | | 0.43 | | | | | | | | |
| BDL187 | 10502.2 | Av | | 1.21 | | | | | | | | |
| BDL187 | 10501.2 | P | 0.01 | 0.58 | | | | | | | | |
| BDL187 | 10501.2 | Av | 1.02 | 1.38 | | | | | | | | |
| BDL187 | 10502.4 | P | | 0.66 | | | | | | | | |
| BDL187 | 10502.4 | Av | | 1.1 | | | | | | | | |
| BDL187 | 10503.5 | P | | 0.38 | 0.2 | 0.34 | | | | | | |
| BDL187 | 10503.5 | Av | | 1.13 | 1.24 | 1.12 | | | | | | |
| BDL188 | 10462.1 | P | | 0.46 | | | | | | | | |
| BDL188 | 10462.1 | Av | | 1.41 | | | | | | | | |
| BDL188 | 10464.5 | P | | | | | | 0.33 | | | | |
| BDL188 | 10464.5 | Av | | | | | | 1.12 | | | | |
| BDL188 | 10462.1 | P | | | | | 0.38 | | 0.35 | | 0.35 | |
| BDL188 | 10462.1 | Av | | | | | 1.16 | | 1.18 | | 1.18 | |
| BDL188 | 10462.4 | P | 0.02 | 0.41 | | | 0.26 | | 0.24 | | 0.24 | |
| BDL188 | 10462.4 | Av | 1.02 | 1.32 | | | 1.2 | | 1.22 | | 1.22 | |
| BDL188 | 10464.3 | P | | 0.66 | | | | | | | | |
| BDL188 | 10464.3 | Av | | 1.24 | | | | | | | | |
| BDL188 | 10464.5 | P | | 0.29 | 0.1 | | | | | | | |
| BDL188 | 10464.5 | Av | | 1.38 | 1.12 | | | | | | | |
| BDL190 | 10232.2 | P | | | | | | | | | | 0.6 |
| BDL190 | 10232.2 | Av | | | | | | | | | | 1.1 |
| BDL190 | 10233.4 | P | | | | | | | | | | 0.01 |
| BDL190 | 10233.4 | Av | | | | | | | | | | 1.2 |
| BDL190 | 10234.1 | P | 0.01 | | | | | | | | | 0.4 |
| BDL190 | 10234.1 | Av | 1.02 | | | | | | | | | 1.14 |
| BDL190 | 10231.1 | P | | 0.42 | 0.24 | | | | | | | |
| BDL190 | 10231.1 | Av | | 1.18 | 1.21 | | | | | | | |
| BDL190 | 10231.2 | P | | 0.64 | | | | | | | | 0.5 |
| BDL190 | 10231.2 | Av | | 1.14 | | | | | | | | 1.2 |
| BDL190 | 10232.2 | P | | <0.01 | | | 0.26 | | 0.14 | | 0.14 | |
| BDL190 | 10232.2 | Av | | 1.29 | | | 1.18 | | 1.25 | | 1.25 | |
| BDL190 | 10233.2 | P | | | | | 0.1 | 0.29 | 0.05 | 0.01 | 0.05 | |
| BDL190 | 10233.2 | Av | | | | | 1.25 | 1.13 | 1.32 | 1.24 | 1.32 | |
| BDL190 | 10233.4 | P | | | | | 0.16 | | 0.29 | 0.29 | 0.29 | |
| BDL190 | 10233.4 | Av | | | | | 1.23 | | 1.17 | 1.1 | 1.17 | |
| BDL190 | 10234.2 | P | | 0.04 | | | | | | | | 0.02 |
| BDL190 | 10234.2 | Av | | 1.11 | | | | | | | | 1.09 |
| BDL192 | 9921.3 | P | | 0.54 | 0.56 | | | 0.16 | | | | |
| BDL192 | 9921.3 | Av | | 1.19 | 1.11 | | | 1.16 | | | | |
| BDL192 | 9921.6 | P | | | | | 0.51 | | 0.47 | | 0.4 | |
| BDL192 | 9921.6 | Av | | | | | 1.1 | | 1.12 | | 1.14 | |
| BDL192 | 9922.1 | P | | | | | | | | | 0.52 | |
| BDL192 | 9922.1 | Av | | | | | | | | | 1.11 | |
| BDL192 | 9922.2 | P | <0.01 | | | | | | | | | |
| BDL192 | 9922.2 | Av | 1.02 | | | | | | | | | |
| BDL192 | 9921.6 | P | | | | | 0.49 | 0.03 | 0.45 | | 0.45 | |
| BDL192 | 9921.6 | Av | | | | | 1.15 | 1.25 | 1.16 | | 1.16 | |
| BDL192 | 9922.5 | P | | | | | | | 0.54 | | | 0.51 |
| BDL192 | 9922.5 | Av | | | | | | | 1.13 | | | 1.15 |
| BDL193 | 10152.2 | P | | | | | | 0.15 | | | | |
| BDL193 | 10152.2 | Av | | | | | | 1.17 | | | | |
| BDL193 | 10152.3 | P | | | | 0.3 | 0.1 | | | | | |
| BDL193 | 10152.3 | Av | | | | 1.11 | 1.2 | | | | | |
| BDL193 | 10153.2 | P | | | | | | 0.24 | | | | |
| BDL193 | 10153.2 | Av | | | | | | 1.14 | | | | |
| BDL193 | 10153.4 | P | 0.04 | | | | 0.39 | | 0.4 | | 0.33 | |
| BDL193 | 10153.4 | Av | 1.02 | | | | 1.14 | | 1.14 | | 1.16 | |
| BDL193 | 10152.2 | P | | | 0.7 | | | | | | | |
| BDL193 | 10152.2 | Av | | | 1.12 | | | | | | | |
| BDL193 | 10152.3 | P | | | | | | 0.14 | | | | |
| BDL193 | 10152.3 | Av | | | | | | 1.16 | | | | |
| BDL193 | 10153.2 | P | 0.01 | | | | | | | | | |
| BDL193 | 10153.2 | Av | 1.02 | | | | | | | | | |
| BDL193 | 10153.3 | P | | 0.35 | | | | 0.4 | 0.48 | | 0.48 | |
| BDL193 | 10153.3 | Av | | 1.22 | | | | 1.1 | 1.14 | | 1.14 | |
| BDL193 | 10153.4 | P | | | | | 0.63 | | 0.5 | | 0.5 | |
| BDL193 | 10153.4 | Av | | | | | 1.1 | | 1.14 | | 1.14 | |

TABLE 26-continued

Results from greenhouse experiments

| Gene | Ev. | Par | 21 | 22 | 23 | 24 | 25 | 26 | 27 | 28 | 29 | 30 |
|---|---|---|---|---|---|---|---|---|---|---|---|---|
| BDL196 | 10241.3 | P | | 0.5 | | | | | | | | |
| BDL196 | 10241.3 | Av | | 1.1 | | | | | | | | |
| BDL196 | 10243.1 | P | | | 0.01 | | | | 0.56 | | 0.56 | |
| BDL196 | 10243.1 | Av | | | 1.08 | | | | 1.14 | | 1.14 | |
| BDL196 | 10243.2 | P | | 0.37 | | | | | | | | |
| BDL196 | 10243.2 | Av | | 1.29 | | | | | | | | |
| BDL196 | 10244.1 | P | | 0.02 | 0.22 | 0.82 | | | | | | 0.02 |
| BDL196 | 10244.1 | Av | | 1.21 | 1.11 | 1.1 | | | | | | 1.13 |
| BDL201 | 9961.3 | P | | | | | 0.12 | | 0.12 | 0.31 | 0.12 | |
| BDL201 | 9961.3 | Av | | | | | 1.31 | | 1.32 | 1.16 | 1.32 | |
| BDL201 | 9961.4 | P | | | 0.62 | | | | | | | |
| BDL201 | 9961.4 | Av | | | 1.14 | | | | | | | |
| BDL201 | 9961.6 | P | 0.01 | 0.01 | | | | | | | | |
| BDL201 | 9961.6 | Av | 1.02 | 1.54 | | | | | | | | |
| BDL201 | 9963.6 | P | | 0.46 | 0.37 | 0.21 | | | | | | |
| BDL201 | 9963.6 | Av | | 1.29 | 1.13 | 1.15 | | | | | | |
| BDL220 | 10331.5 | P | | 0.76 | | | | | | | | |
| BDL220 | 10331.5 | Av | | 1.13 | | | | | | | | |
| BDL220 | 10331.7 | P | | | 0.62 | 0.42 | 0.29 | | | | | |
| BDL220 | 10331.7 | Av | | | 1.21 | 1.17 | 1.18 | | | | | |
| BDL220 | 10333.2 | P | | 0.62 | | | | | | | | |
| BDL220 | 10333.2 | Av | | 1.49 | | | | | | | | |
| BDL220 | 10333.5 | P | | | 0.01 | 0.25 | | | 0.26 | | 0.65 | |
| BDL220 | 10333.5 | Av | | | 1.13 | 1.22 | | | 1.18 | | 1.14 | |
| BDL220 | 10334.1 | P | <0.01 | | 0.36 | 0.64 | | | | | | |
| BDL220 | 10334.1 | Av | 1.04 | | 1.31 | 1.11 | | | | | | |
| BDL223 | 10791.1 | P | | | | 0.51 | | | | | | |
| BDL223 | 10791.1 | Av | | | | 1.78 | | | | | | |
| BDL223 | 10793.1 | P | | 0.02 | 0.58 | | | | | | | |
| BDL223 | 10793.1 | Av | | 1.16 | 1.34 | | | | | | | |
| BDL223 | 10793.3 | P | | | 0.7 | | | | | | | |
| BDL223 | 10793.3 | Av | | | 1.1 | | | | | | | |
| BDL223 | 10793.5 | P | | 0.01 | <0.01 | 0.42 | | 0.48 | | 0.48 | 0.18 | |
| BDL223 | 10793.5 | Av | | 1.18 | 1.41 | 1.15 | | 1.13 | | 1.13 | 1.17 | |
| BDL223 | 10793.8 | P | | 0.6 | | | | | | | | |
| BDL223 | 10793.8 | Av | | 1.36 | | | | | | | | |
| BDL224 | 10451.3 | P | | | | | | | 0.61 | 0.5 | 0.61 | |
| BDL224 | 10451.3 | Av | | | | | | | 1.1 | 1.11 | 1.1 | |
| BDL224 | 10451.7 | P | | | | | | | | | | 0.78 |
| BDL224 | 10451.7 | Av | | | | | | | | | | 1.11 |
| BDL224 | 10451.8 | P | | 0.03 | | | | | | | | 0.54 |
| BDL224 | 10451.8 | Av | | 1.78 | | | | | | | | 1.11 |
| BDL224 | 10453.1 | P | | | | | | | | | | 0.77 |
| BDL224 | 10453.1 | Av | | | | | | | | | | 1.11 |
| BDL224 | 10453.3 | P | | 0.62 | | | | 0.39 | | | | |
| BDL224 | 10453.3 | Av | | 1.82 | | | | 1.14 | | | | |
| BDL225 | 10401.4 | P | | | | | | 0.18 | | | | |
| BDL225 | 10401.4 | Av | | | | | | 1.17 | | | | |
| BDL225 | 10402.2 | P | | 0.29 | 0.74 | | | | | | | |
| BDL225 | 10402.2 | Av | | 1.28 | 1.1 | | | | | | | |
| BDL225 | 10402.5 | P | | | 0.38 | | | | | | | |
| BDL225 | 10402.5 | Av | | | 1.13 | | | | | | | |
| BDL225 | 10401.4 | P | | 0.5 | | | | | | | | 0.65 |
| BDL225 | 10401.4 | Av | | 1.12 | | | | | | | | 1.15 |
| BDL225 | 10402.2 | P | | | 0.42 | | | | | | | 0.38 |
| BDL225 | 10402.2 | Av | | | 1.1 | | | | | | | 1.15 |
| BDL225 | 10402.6 | P | | | | | | | | | | 0.38 |
| BDL225 | 10402.6 | Av | | | | | | | | | | 1.15 |
| BDL225 | 10402.9 | P | | | 0.07 | 0.01 | | | | | | |
| BDL225 | 10402.9 | Av | | | 1.14 | 1.15 | | | | | | |
| BDL226 | 10861.2 | P | | | 0.53 | 0.54 | | | | | | |
| BDL226 | 10861.2 | Av | | | 1.22 | 1.12 | | | | | | |
| BDL226 | 10862.2 | P | 0.03 | | | | | | | | | |
| BDL226 | 10862.2 | Av | 1.03 | | | | | | | | | |
| BDL226 | 10864.2 | P | | | 0.44 | | 0.58 | 0.32 | 0.21 | | | |
| BDL226 | 10864.2 | Av | | | 1.17 | | 1.1 | 1.2 | 1.27 | | | |
| BDL226 | 10861.1 | P | | | 0.68 | 0.72 | | | | | | |
| BDL226 | 10861.1 | Av | | | 1.27 | 1.21 | | | | | | |
| BDL226 | 10861.4 | P | | 0.04 | | 0.41 | | | | | | |
| BDL226 | 10861.4 | Av | | 1.13 | | 1.44 | | | | | | |
| BDL226 | 10862.2 | P | | | | 0.21 | | | | | | |
| BDL226 | 10862.2 | Av | | | | 1.51 | | | | | | |
| BDL226 | 10863.4 | P | | | 0.53 | | | | | | | |
| BDL226 | 10863.4 | Av | | | 2.04 | | | | | | | |
| BDL227 | 11491.1 | P | | 0.08 | | 0.45 | | | | | | |
| BDL227 | 11491.1 | Av | | 1.17 | | 2.04 | | | | | | |

TABLE 26-continued

Results from greenhouse experiments

| Gene | Ev. | Par | 21 | 22 | 23 | 24 | 25 | 26 | 27 | 28 | 29 | 30 |
|---|---|---|---|---|---|---|---|---|---|---|---|---|
| BDL227 | 11491.3 | P |  | 0.13 |  | 0.34 |  |  |  |  |  | 0.08 |
| BDL227 | 11491.3 | Av |  | 1.1 |  | 1.78 |  |  |  |  |  | 1.15 |
| BDL227 | 11491.5 | P |  | 0.66 |  |  |  |  |  |  |  |  |
| BDL227 | 11491.5 | Av |  | 1.15 |  |  |  |  |  |  |  |  |
| BDL227 | 11492.3 | P |  | 0.04 |  | 0.71 | 0.48 |  | 0.49 |  | 0.49 | 0.02 |
| BDL227 | 11492.3 | Av |  | 1.13 |  | 1.15 | 1.13 |  | 1.12 |  | 1.12 | 1.2 |
| BDL227 | 11492.5 | P |  |  |  | 0.66 |  |  |  |  |  |  |
| BDL227 | 11492.5 | Av |  |  |  | 1.29 |  |  |  |  |  |  |
| BDL227 | 11493.5 | P |  |  | 0.65 |  |  |  |  |  |  |  |
| BDL227 | 11493.5 | Av |  |  | 1.38 |  |  |  |  |  |  |  |
| BDL230 | 10672.4 | P |  | 0.79 |  |  |  |  |  |  |  |  |
| BDL230 | 10672.4 | Av |  | 1.1 |  |  |  |  |  |  |  |  |
| BDL230 | 10673.2 | P |  |  |  |  |  | 0.42 |  |  |  |  |
| BDL230 | 10673.2 | Av |  |  |  |  |  | 1.1 |  |  |  |  |
| BDL233 | 10822.1 | P |  |  |  | 0.14 |  |  |  |  |  |  |
| BDL233 | 10822.1 | Av |  |  |  | 1.37 |  |  |  |  |  |  |
| BDL233 | 10822.2 | P |  | 0.02 |  | 0.46 |  |  |  |  |  |  |
| BDL233 | 10822.2 | Av |  | 1.16 |  | 1.4 |  |  |  |  |  |  |
| BDL233 | 10824.2 | P |  |  |  | 0.46 |  |  |  |  |  |  |
| BDL233 | 10824.2 | Av |  |  |  | 1.69 |  |  |  |  |  |  |
| BDL233 | 10825.4 | P |  | 0.03 |  | 0.16 | 0.15 |  | 0.19 | 0.12 | 0.19 |  |
| BDL233 | 10825.4 | Av |  | 1.16 |  | 1.15 | 1.3 |  | 1.26 | 1.17 | 1.26 |  |
| BDL237 | 10892.2 | P |  | 0.23 |  |  |  |  |  |  |  |  |
| BDL237 | 10892.2 | Av |  | 1.15 |  |  |  |  |  |  |  |  |
| BDL237 | 10893.1 | P |  |  | 0.48 |  |  |  |  |  |  |  |
| BDL237 | 10893.1 | Av |  |  | 2.25 |  |  |  |  |  |  |  |
| BDL237 | 10895.1 | P |  | 0.57 | 0.48 | 0.47 |  |  | 0.54 |  | 0.54 |  |
| BDL237 | 10895.1 | Av |  | 1.11 | 1.28 | 1.35 |  |  | 1.11 |  | 1.11 |  |
| BDL237 | 10895.2 | P |  |  |  |  |  |  |  |  |  | 0.61 |
| BDL237 | 10895.2 | Av |  |  |  |  |  |  |  |  |  | 1.11 |
| BDL237 | 10895.3 | P |  | 0.03 | 0.48 |  |  |  |  |  |  |  |
| BDL237 | 10895.3 | Av |  | 1.18 | 2.07 |  |  |  |  |  |  |  |
| BDL238 | 10951.4 | P |  | 0.03 |  |  |  |  |  |  |  |  |
| BDL238 | 10951.4 | Av |  | 1.16 |  |  |  |  |  |  |  |  |
| BDL238 | 10952.3 | P |  |  |  | 0.12 |  | 0.16 |  |  |  |  |
| BDL238 | 10952.3 | Av |  |  |  | 1.15 |  | 1.16 |  |  |  |  |
| BDL238 | 10953.1 | P |  |  | 0.43 |  |  |  |  |  |  |  |
| BDL238 | 10953.1 | Av |  |  | 1.2 |  |  |  |  |  |  |  |
| BDL238 | 10953.3 | P |  | 0.36 |  |  |  |  |  |  |  |  |
| BDL238 | 10953.3 | Av |  | 1.18 |  |  |  |  |  |  |  |  |
| BDL238 | 10954.2 | P |  |  |  |  | 0.02 |  | 0.01 | 0.05 | 0.01 | 0.04 |
| BDL238 | 10954.2 | Av |  |  |  |  | 1.45 |  | 1.5 | 1.19 | 1.5 | 1.25 |
| BDL238 | 10954.3 | P |  |  | 0.16 |  |  |  |  |  |  |  |
| BDL238 | 10954.3 | Av |  |  | 1.77 |  |  |  |  |  |  |  |
| BDL240 | 10802.2 | P |  | 0.24 |  | 0.44 | 0.1 |  | 0.07 | 0.06 | 0.07 | 0.25 |
| BDL240 | 10802.2 | Av |  | 1.15 |  | 1.45 | 1.3 |  | 1.35 | 1.18 | 1.35 | 1.28 |
| BDL240 | 10803.1 | P |  |  |  | 0.62 |  |  |  |  |  |  |
| BDL240 | 10803.1 | Av |  |  |  | 1.45 |  |  |  |  |  |  |
| BDL240 | 10803.5 | P |  |  | 0.63 |  |  |  |  |  |  |  |
| BDL240 | 10803.5 | Av |  |  | 1.4 |  |  |  |  |  |  |  |
| BDL240 | 10806.2 | P |  | 0.09 |  |  |  |  |  |  |  | 0.39 |
| BDL240 | 10806.2 | Av |  | 1.1 |  |  |  |  |  |  |  | 1.11 |
| BDL241 | 10873.1 | P |  |  | 0.55 |  | 0.11 |  | 0.09 | 0.17 | 0.09 | 0.34 |
| BDL241 | 10873.1 | Av |  |  | 1.86 |  | 1.32 |  | 1.33 | 1.13 | 1.33 | 1.25 |
| BDL241 | 10873.4 | P |  |  |  | 0.44 |  |  |  |  |  |  |
| BDL241 | 10873.4 | Av |  |  |  | 1.73 |  |  |  |  |  |  |
| BDL241 | 10874.2 | P | <0.01 |  |  |  |  |  |  |  |  |  |
| BDL241 | 10874.2 | Av | 1.03 |  |  |  |  |  |  |  |  |  |
| BDL241 | 10875.1 | P |  |  |  | 0.33 |  |  |  |  |  |  |
| BDL241 | 10875.1 | Av |  |  |  | 1.57 |  |  |  |  |  |  |
| BDL241 | 10875.2 | P |  |  | 0.58 | 0.09 |  |  |  |  |  |  |
| BDL241 | 10875.2 | Av |  |  | 1.48 | 1.19 |  |  |  |  |  |  |
| BDL242 | 10731.2 | P |  |  |  |  | 0.59 |  | 0.46 |  | 0.46 |  |
| BDL242 | 10731.2 | Av |  |  |  |  | 1.1 |  | 1.14 |  | 1.14 |  |
| BDL242 | 10731.3 | P |  |  | <0.01 |  |  |  |  |  |  |  |
| BDL242 | 10731.3 | Av |  |  | 1.74 |  |  |  |  |  |  |  |
| BDL242 | 10731.5 | P |  |  | 0.7 |  |  |  |  |  |  |  |
| BDL242 | 10731.5 | Av |  |  | 1.18 |  |  |  |  |  |  |  |
| BDL242 | 10731.6 | P |  |  | 0.63 |  | 0.07 |  | 0.07 | 0.09 | 0.07 | 0.04 |
| BDL242 | 10731.6 | Av |  |  | 1.48 |  | 1.36 |  | 1.35 | 1.17 | 1.35 | 1.16 |
| BDL242 | 10731.7 | P |  |  | 0.18 |  |  |  |  |  |  |  |
| BDL242 | 10731.7 | Av |  |  | 2.28 |  |  |  |  |  |  |  |
| BDL242 | 10737.2 | P |  |  |  | 0.07 |  |  |  |  |  |  |
| BDL242 | 10737.2 | Av |  |  |  | 1.22 |  |  |  |  |  |  |
| BDL245 | 10811.3 | P |  | 0.22 | 0.05 | <0.01 |  | 0.2 |  |  |  |  |
| BDL245 | 10811.3 | Av |  | 1.47 | 1.25 | 1.25 |  | 1.16 |  |  |  |  |

TABLE 26-continued

Results from greenhouse experiments

| Gene | Ev. | Par | 21 | 22 | 23 | 24 | 25 | 26 | 27 | 28 | 29 | 30 |
|---|---|---|---|---|---|---|---|---|---|---|---|---|
| BDL245 | 10813.3 | P | | | 0.28 | 0.02 | | 0.22 | | | | |
| BDL245 | 10813.3 | Av | | | 1.17 | 1.33 | | 1.15 | | | | |
| BDL245 | 10811.2 | P | | 0.37 | | 0.3 | | | | | | |
| BDL245 | 10811.2 | Av | | 1.22 | | 1.49 | | | | | | |
| BDL245 | 10811.3 | P | | 0.21 | 0.12 | 0.5 | | | | | | |
| BDL245 | 10811.3 | Av | | 1.18 | 1.44 | 1.79 | | | | | | |
| BDL245 | 10812.3 | P | | | 0.55 | 0.11 | | | | | | |
| BDL245 | 10812.3 | Av | | | 2.2 | 1.12 | | | | | | |
| BDL245 | 10813.3 | P | | 0.37 | | 0.45 | | 0.04 | | | | |
| BDL245 | 10813.3 | Av | | 1.19 | | 1.1 | | 1.26 | | | | |
| BDL245 | 10816.3 | P | | | 0.52 | 0.23 | | | | | | |
| BDL245 | 10816.3 | Av | | | 1.81 | 1.14 | | | | | | |
| BDL247 | 10911.4 | P | | 0.42 | | | | | | | | |
| BDL247 | 10911.4 | Av | | 1.1 | | | | | | | | |
| BDL247 | 10912.1 | P | | | 0.48 | 0.58 | | | | | | |
| BDL247 | 10912.1 | Av | | | 1.26 | 1.16 | | | | | | |
| BDL247 | 10912.6 | P | | | | 0.6 | | | | | | |
| BDL247 | 10912.6 | Av | | | | 1.33 | | | | | | |
| BDL248 | 11051.2 | P | | 0.45 | | | | | | | | |
| BDL248 | 11051.2 | Av | | 1.14 | | | | | | | | |
| BDL250 | 10841.3 | P | | 0.2 | | 0.13 | 0.58 | | 0.36 | | 0.36 | |
| BDL250 | 10841.3 | Av | | 1.14 | | 1.16 | 1.1 | | 1.17 | | 1.17 | |
| BDL250 | 10842.1 | P | | 0.45 | | 0.37 | | | | | | |
| BDL250 | 10842.1 | Av | | 1.12 | | 1.31 | | | | | | |
| BDL250 | 10842.3 | P | | 0.02 | | 0.46 | | | | | | |
| BDL250 | 10842.3 | Av | | 1.15 | | 1.14 | | | | | | |
| BDL250 | 10843.2 | P | | | | 0.42 | | | | | | |
| BDL250 | 10843.2 | Av | | | | 1.19 | | | | | | |
| BDL250 | 10846.2 | P | | 0.01 | | 0.06 | | | | | | |
| BDL250 | 10846.2 | Av | | 1.17 | | 1.22 | | | | | | |
| BDL250 | 10846.3 | P | | | 0.48 | 0.22 | 0.26 | | 0.34 | 0.25 | 0.34 | |
| BDL250 | 10846.3 | Av | | | 1.13 | 1.11 | 1.23 | | 1.19 | 1.12 | 1.19 | |
| BDL252 | 10881.1 | P | | 0.54 | | | | | | | | |
| BDL252 | 10881.1 | Av | | 2.4 | | | | | | | | |
| BDL252 | 10882.1 | P | | | 0.59 | 0.24 | | 0.2 | 0.14 | 0.2 | | |
| BDL252 | 10882.1 | Av | | | 1.24 | 1.22 | | 1.24 | 1.16 | 1.24 | | |
| BDL252 | 10882.2 | P | | | 0.5 | 0.71 | | | | | | |
| BDL252 | 10882.2 | Av | | | 1.52 | 1.27 | | | | | | |
| BDL252 | 10882.4 | P | | | 0.52 | | | | | | | |
| BDL252 | 10882.4 | Av | | | 2.2 | | | | | | | |
| BDL252 | 10884.1 | P | | 0.22 | | 0.27 | | | | | | |
| BDL252 | 10884.1 | Av | | 1.16 | | 1.28 | | | | | | |
| BDL48 | 10271.1 | P | | | 0.01 | | | | | | 0.34 | |
| BDL48 | 10271.1 | Av | | | 1.22 | | | | | | 1.3 | |
| BDL48 | 10271.3 | P | | | | 0.33 | | 0.31 | | | | |
| BDL48 | 10271.3 | Av | | | | 1.23 | | 1.17 | | | | |
| BDL48 | 10271.5 | P | <0.01 | | | | | | | | | |
| BDL48 | 10271.5 | Av | 1.03 | | | | | | | | | |
| BDL48 | 10274.4 | P | | 0.5 | 0.02 | 0.01 | 0.07 | 0.52 | 0.06 | 0.15 | 0.06 | 0.01 |
| BDL48 | 10274.4 | Av | | 2.17 | 1.24 | 1.13 | 1.34 | 1.11 | 1.37 | 1.22 | 1.37 | 1.51 |
| BDL48 | 10271.1 | P | | | | 0.13 | 0.12 | 0.08 | 0.03 | 0.08 | | |
| BDL48 | 10271.1 | Av | | | | 1.25 | 1.17 | 1.29 | 1.2 | 1.29 | | |
| BDL48 | 10271.3 | P | | 0.21 | | | | | | | | |
| BDL48 | 10271.3 | Av | | 1.1 | | | | | | | | |
| BDL48 | 10271.5 | P | | <0.01 | | | | | | | | |
| BDL48 | 10271.5 | Av | | 1.26 | | | | | | | | |
| BDL48 | 10274.3 | P | | 0.01 | | 0.31 | | 0.18 | | 0.18 | | |
| BDL48 | 10274.3 | Av | | 1.18 | | 1.15 | | 1.21 | | 1.21 | | |
| BDL48 | 10274.4 | P | | 0.57 | | 0.22 | | 0.12 | 0.18 | 0.12 | | |
| BDL48 | 10274.4 | Av | | 1.13 | | 1.2 | | 1.27 | 1.12 | 1.27 | | |
| BDL48 | 10274.5 | P | | | <0.01 | 0.45 | 0.35 | 0.2 | 0.3 | 0.2 | | |
| BDL48 | 10274.5 | Av | | | 1.16 | 1.13 | 1.11 | 1.22 | 1.1 | 1.22 | | |
| BDL58 | 10281.2 | P | | | 0.26 | | 0.27 | | | | | |
| BDL58 | 10281.2 | Av | | | 1.11 | | 1.19 | | | | | |
| BDL58 | 10281.3 | P | | 0.65 | 0.64 | | | | | | | |
| BDL58 | 10281.3 | Av | | 1.23 | 1.2 | | | | | | | |
| BDL58 | 10281.5 | P | | | | 0.01 | | | | | | |
| BDL58 | 10281.5 | Av | | | | 1.12 | | | | | | |
| BDL58 | 10282.3 | P | | | | 0.02 | | | | | | |
| BDL58 | 10282.3 | Av | | | | 1.11 | | | | | | |
| BDL63 | 10381.1 | P | | 0.62 | 0.25 | 0.39 | | | | | | |
| BDL63 | 10381.1 | Av | | 1.35 | 1.28 | 1.11 | | | | | | |
| BDL63 | 10381.2 | P | | 0.1 | 0.19 | 0.39 | | | | | | |
| BDL63 | 10381.2 | Av | | 1.67 | 1.19 | 1.12 | | | | | | |
| BDL63 | 10384.5 | P | | 0.54 | | 0.05 | | | | | 0.29 | |
| BDL63 | 10384.5 | Av | | 1.95 | | 1.09 | | | | | 1.19 | |

TABLE 26-continued

Results from greenhouse experiments

| Gene | Ev. | Par | 21 | 22 | 23 | 24 | 25 | 26 | 27 | 28 | 29 | 30 |
|---|---|---|---|---|---|---|---|---|---|---|---|---|
| BDL63 | 10381.1 | P | | | | | 0.06 | | 0.02 | 0.04 | 0.02 | <0.01 |
| BDL63 | 10381.1 | Av | | | | | 1.31 | | 1.4 | 1.18 | 1.4 | 1.16 |
| BDL63 | 10381.2 | P | 0.06 | | | | 0.19 | | 0.1 | 0.07 | 0.1 | |
| BDL63 | 10381.2 | Av | 1.02 | | | | 1.25 | | 1.32 | 1.2 | 1.32 | |
| BDL63 | 10384.2 | P | | | 0.41 | 0.45 | | | | | | <0.01 |
| BDL63 | 10384.2 | Av | | | 1.14 | 1.12 | | | | | | 1.17 |
| BDL63 | 10384.3 | P | | | | | | | | | | 0.3 |
| BDL63 | 10384.3 | Av | | | | | | | | | | 1.14 |
| BDL63 | 10384.7 | P | | 0.04 | | | | | | | | <0.01 |
| BDL63 | 10384.7 | Av | | 1.12 | | | | | | | | 1.16 |
| BDL63 | 10384.8 | P | | | | | 0.12 | | 0.11 | 0.06 | 0.11 | 0.31 |
| BDL63 | 10384.8 | Av | | | | | 1.25 | | 1.26 | 1.17 | 1.26 | 1.12 |
| BDL79 | 11041.1 | P | | 0.13 | 0.49 | 0.77 | | | | | | |
| BDL79 | 11041.1 | Av | | 1.11 | 2.06 | 1.1 | | | | | | |
| BDL79 | 11042.1 | P | | 0.09 | | | 0.2 | | 0.54 | | 0.54 | |
| BDL79 | 11042.1 | Av | | 1.15 | | | 1.16 | | 1.11 | | 1.11 | |
| BDL79 | 11042.3 | P | | | 0.46 | | | | | | | |
| BDL79 | 11042.3 | Av | | | 1.37 | | | | | | | |
| BDL79 | 11043.1 | P | | | 0.47 | | | | | | | |
| BDL79 | 11043.1 | Av | | | 1.92 | | | | | | | |
| BDL79 | 11044.3 | P | | 0.01 | | 0.15 | | | | | | |
| BDL79 | 11044.3 | Av | | 1.21 | | 1.23 | | | | | | |
| BDL81 | 10371.5 | P | | | 0.6 | | | | | | | |
| BDL81 | 10371.5 | Av | | | 1.27 | | | | | | | |
| BDL81 | 10371.8 | P | | | 0.51 | | | | | | | |
| BDL81 | 10371.8 | Av | | | 2.2 | | | | | | | |
| BDL81 | 10372.1 | P | | | 0.54 | | | | | | | |
| BDL81 | 10372.1 | Av | | | 2.43 | | | | | | | |
| BDL81 | 10372.2 | P | | 0.06 | 0.66 | | | | | | | |
| BDL81 | 10372.2 | Av | | 1.12 | 1.28 | | | | | | | |
| BDL81 | 10374.1 | P | | | 0.42 | | | | | | | |
| BDL81 | 10374.1 | Av | | | 1.99 | | | | | | | |
| BDL81 | 10371.5 | P | | | | 0.01 | 0.25 | | 0.37 | 0.14 | 0.37 | 0.07 |
| BDL81 | 10371.5 | Av | | | | 1.13 | 1.18 | | 1.14 | 1.13 | 1.14 | 1.11 |
| BDL81 | 10371.8 | P | | 0.2 | 0.05 | 0.02 | 0.33 | | 0.23 | 0.19 | 0.23 | 0.04 |
| BDL81 | 10371.8 | Av | | 1.12 | 1.1 | 1.1 | 1.19 | | 1.24 | 1.18 | 1.24 | 1.07 |
| BDL81 | 10372.1 | P | | 0.05 | | | | | | | | |
| BDL81 | 10372.1 | Av | | 1.1 | | | | | | | | |
| BDL81 | 10372.2 | P | | 0.33 | 0.4 | | | | | | | 0.59 |
| BDL81 | 10372.2 | Av | | 1.13 | 1.29 | | | | | | | 1.18 |
| BDL81 | 10373.2 | P | | 0.01 | | | | | | | | |
| BDL81 | 10373.2 | Av | | 1.19 | | | | | | | | |
| BDL81 | 10374.1 | P | | | | | 0.06 | | 0.02 | 0.23 | 0.02 | 0.04 |
| BDL81 | 10374.1 | Av | | | | | 1.35 | | 1.48 | 1.14 | 1.48 | 1.15 |
| BDL85 | 10411.1 | P | | | | 0.01 | 0.12 | | 0.12 | 0.26 | 0.12 | 0.07 |
| BDL85 | 10411.1 | Av | | | | 1.09 | 1.29 | | 1.28 | 1.12 | 1.28 | 1.16 |
| BDL85 | 10411.3 | P | | 0.59 | | | | | | | | |
| BDL85 | 10411.3 | Av | | 1.51 | | | | | | | | |
| BDL85 | 10412.2 | P | | 0.62 | | | | | | | | |
| BDL85 | 10412.2 | Av | | 1.6 | | | | | | | | |
| BDL85 | 10414.1 | P | 0.1 | | | | | | | | | |
| BDL85 | 10414.1 | Av | 1.03 | | | | | | | | | |
| BDL85 | 10414.2 | P | | | | | | | | | | 0.62 |
| BDL85 | 10414.2 | Av | | | | | | | | | | 1.19 |

Table 26. Results of the greenhouse experiments. Provided are the measured values of each parameter [parameters (Par.) 21-30 according to the parameters described in Table 23 above] in plants expressing the indicated polynucleotides.
"Ev" = event;
"P" = P-value;
"Av" = ratio between the averages of event and control.
Note that when the average ratio is higher than "1" the effect of exogenous expression of the gene is an increase of the desired trait;

TABLE 27

Results from greenhouse experiments

| Gene | Ev. | Par | 31 | 32 | 33 | 34 | 35 | 36 | 37 |
|---|---|---|---|---|---|---|---|---|---|
| BDL102 | 10471.1 | P | 0.12 | | | | | | |
| BDL102 | 10471.1 | Av | 1.12 | | | | | | |
| BDL102 | 10474.1 | P | 0.26 | | | | | | |
| BDL102 | 10474.1 | Av | 1.35 | | | | | | |
| BDL117 | 10074.1 | P | | | | 0.69 | | | |
| BDL117 | 10074.1 | Av | | | | 1.1 | | | |

TABLE 27-continued

Results from greenhouse experiments

| Gene | Ev. | Par | 31 | 32 | 33 | 34 | 35 | 36 | 37 |
|---|---|---|---|---|---|---|---|---|---|
| BDL117 | 10074.4 | P | | | | 0.45 | | | |
| BDL117 | 10074.4 | Av | | | | 1.14 | | | |
| BDL138 | 9811.1 | P | | 0.06 | 0.11 | | 0.22 | | |
| BDL138 | 9811.1 | Av | | 1.18 | 1.11 | | 1.1 | | |
| BDL138 | 9811.4 | P | | <0.01 | 0.19 | | 0.48 | | |
| BDL138 | 9811.4 | Av | | 1.21 | 1.11 | | 1.2 | | |
| BDL138 | 9813.1 | P | | 0.1 | | | 0.02 | | |
| BDL138 | 9813.1 | Av | | 1.17 | | | 1.05 | | |
| BDL138 | 9813.4 | P | | | | | | 0.01 | |
| BDL138 | 9813.4 | Av | | | | | | 1.08 | |
| BDL138 | 9811.1 | P | | | | | 0.26 | 0.58 | |
| BDL138 | 9811.1 | Av | | | | | 1.15 | 1.13 | |
| BDL138 | 9811.4 | P | | <0.01 | 0.02 | | | | |
| BDL138 | 9811.4 | Av | | 1.18 | 1.18 | | | | |
| BDL138 | 9812.1 | P | | 0.01 | 0.03 | | 0.1 | | |
| BDL138 | 9812.1 | Av | | 1.13 | 1.1 | | 1.07 | | |
| BDL138 | 9813.1 | P | | 0.02 | 0.09 | | | | |
| BDL138 | 9813.1 | Av | | 1.09 | 1.08 | | | | |
| BDL138 | 9813.3 | P | | 0.09 | 0.03 | | | | |
| BDL138 | 9813.3 | Av | | 1.17 | 1.16 | | | | |
| BDL140 | 10423.1 | P | 0.71 | | | | | | |
| BDL140 | 10423.1 | Av | 1.11 | | | | | | |
| BDL147 | 10301.5 | P | | 0.01 | | | | | |
| BDL147 | 10301.5 | Av | | 1.1 | | | | | |
| BDL147 | 10301.6 | P | | 0.06 | 0.02 | | | | |
| BDL147 | 10301.6 | Av | | 1.14 | 1.09 | | | | |
| BDL147 | 10303.1 | P | | 0.16 | | | | 0.66 | |
| BDL147 | 10303.1 | Av | | 1.11 | | | | 1.14 | |
| BDL147 | 10303.5 | P | | 0.01 | 0.01 | | | | |
| BDL147 | 10303.5 | Av | | 1.13 | 1.11 | | | | |
| BDL147 | 10303.6 | P | | | | | | 0.1 | |
| BDL147 | 10303.6 | Av | | | | | | 1.13 | |
| BDL149 | 9824.4 | P | 0.01 | | | | | | |
| BDL149 | 9824.4 | Av | 1.19 | | | | | | |
| BDL152 | 10434.4 | P | 0.8 | | | | | | |
| BDL152 | 10434.4 | Av | 1.13 | | | | | | |
| BDL153 | 10143.1 | P | | | | 0.65 | | 0.52 | |
| BDL153 | 10143.1 | Av | | | | 1.1 | | 1.19 | |
| BDL153 | 10143.2 | P | | | | 0.26 | | | 0.05 |
| BDL153 | 10143.2 | Av | | | | 1.1 | | | 1.02 |
| BDL155 | 9991.5 | P | 0.56 | | | | | | |
| BDL155 | 9991.5 | Av | 1.23 | | | | | | |
| BDL155 | 9991.9 | P | 0.1 | | | | | | |
| BDL155 | 9991.9 | Av | 1.31 | | | | | | |
| BDL155 | 9993.2 | P | 0.62 | | | | | | |
| BDL155 | 9993.2 | Av | 1.1 | | | | | | |
| BDL155 | 9994.3 | P | 0.47 | | | | | | |
| BDL155 | 9994.3 | Av | 1.14 | | | | | | |
| BDL157 | 9911.3 | P | | 0.02 | 0.33 | | | | |
| BDL157 | 9911.3 | Av | | 1.32 | 1.19 | | | | |
| BDL157 | 9911.4 | P | | | | 0.64 | | | |
| BDL157 | 9911.4 | Av | | | | 1.14 | | | |
| BDL157 | 9913.1 | P | | 0.01 | <0.01 | | | | |
| BDL157 | 9913.1 | Av | | 1.19 | 1.08 | | | | |
| BDL157 | 9913.3 | P | | 0.11 | | | | | |
| BDL157 | 9913.3 | Av | | 1.17 | | | | | |
| BDL157 | 9914.2 | P | | 0.13 | | | 0.4 | | |
| BDL157 | 9914.2 | Av | | 1.18 | | | 1.1 | | |
| BDL157 | 9911.3 | P | | 0.15 | | | | | |
| BDL157 | 9911.3 | Av | | 1.13 | | | | | |
| BDL157 | 9913.1 | P | | | | | | 0.36 | |
| BDL157 | 9913.1 | Av | | | | | | 1.15 | |
| BDL157 | 9913.3 | P | | | | | | 0.03 | |
| BDL157 | 9913.3 | Av | | | | | | 1.06 | |
| BDL157 | 9914.2 | P | | | | 0.22 | | | |
| BDL157 | 9914.2 | Av | | | | 1.18 | | | |
| BDL162 | 10492.2 | P | 0.1 | | | | | | |
| BDL162 | 10492.2 | Av | 1.8 | | | | | | |
| BDL167 | 10042.3 | P | | 0.14 | | | | | |
| BDL167 | 10042.3 | Av | | 1.15 | | | | | |
| BDL167 | 10042.4 | P | | 0.01 | 0.01 | 0.19 | 0.01 | | |
| BDL167 | 10042.4 | Av | | 1.15 | 1.05 | 1.1 | 1.06 | | |
| BDL167 | 10043.1 | P | | 0.01 | 0.04 | | <0.01 | | |
| BDL167 | 10043.1 | Av | | 1.16 | 1.06 | | 1.1 | | |
| BDL167 | 10043.3 | P | | 0.04 | 0.08 | | 0.01 | | |
| BDL167 | 10043.3 | Av | | 1.15 | 1.05 | | 1.06 | | |

TABLE 27-continued

Results from greenhouse experiments

| Gene | Ev. | Par | 31 | 32 | 33 | 34 | 35 | 36 | 37 |
|---|---|---|---|---|---|---|---|---|---|
| BDL167 | 10044.2 | P | | | | | 0.52 | | |
| BDL167 | 10044.2 | Av | | | | | 1.11 | | |
| BDL167 | 10043.2 | P | | | | 0.44 | 0.07 | | |
| BDL167 | 10043.2 | Av | | | | 1.22 | 1.08 | | |
| BDL167 | 10043.3 | P | | | | <0.01 | | | |
| BDL167 | 10043.3 | Av | | | | 1.2 | | | |
| BDL167 | 10043.4 | P | | | | 0.22 | | 0.2 | |
| BDL167 | 10043.4 | Av | | | | 1.21 | | 1.2 | |
| BDL167 | 10044.2 | P | | | | 0.1 | | | 0.05 |
| BDL167 | 10044.2 | Av | | | | 1.22 | | | 1.03 |
| BDL168 | 9881.3 | P | | | | <0.01 | | | |
| BDL168 | 9881.3 | Av | | | | 1.27 | | | |
| BDL168 | 9881.4 | P | | | | | 0.4 | 0.42 | |
| BDL168 | 9881.4 | Av | | | | | 1.21 | 1.2 | |
| BDL168 | 9882.1 | P | | | | | | 0.11 | |
| BDL168 | 9882.1 | Av | | | | | | 1.39 | |
| BDL168 | 9882.3 | P | | | | | | 0.18 | |
| BDL168 | 9882.3 | Av | | | | | | 1.32 | |
| BDL169 | 10744.2 | P | 0.57 | | | | | | |
| BDL169 | 10744.2 | Av | 1.16 | | | | | | |
| BDL169 | 10747.1 | P | 0.46 | | | | | | |
| BDL169 | 10747.1 | Av | 1.11 | | | | | | |
| BDL169 | 10747.5 | P | 0.28 | | | | | | |
| BDL169 | 10747.5 | Av | 1.16 | | | | | | |
| BDL171 | 10661.2 | P | 0.7 | | | | | | |
| BDL171 | 10661.2 | Av | 1.23 | | | | | | |
| BDL171 | 10664.1 | P | 0.6 | | | | | | |
| BDL171 | 10664.1 | Av | 1.39 | | | | | | |
| BDL173 | 9951.2 | P | 0.66 | | | | | | |
| BDL173 | 9951.2 | Av | 1.13 | | | | | | |
| BDL173 | 9952.1 | P | | | | 0.21 | 0.12 | | |
| BDL173 | 9952.1 | Av | | | | 1.23 | 1.14 | | |
| BDL173 | 9952.2 | P | | 0.14 | | 0.64 | 0.34 | | 0.04 |
| BDL173 | 9952.2 | Av | | 1.1 | | 1.15 | 1.11 | | 1.04 |
| BDL173 | 9953.4 | P | | 0.58 | | <0.01 | 0.47 | 0.06 | |
| BDL173 | 9953.4 | Av | | 1.13 | | 1.41 | 1.1 | 1.1 | |
| BDL173 | 9954.2 | P | | 0.12 | 0.05 | 0.22 | | | |
| BDL173 | 9954.2 | Av | | 1.17 | 1.08 | 1.1 | | | |
| BDL173 | 9954.5 | P | | <0.01 | 0.04 | 0.57 | | | 0.07 |
| BDL173 | 9954.5 | Av | | 1.21 | 1.09 | 1.13 | | | 1.03 |
| BDL176 | 9891.2 | P | | 0.01 | <0.01 | 0.31 | 0.01 | | <0.01 |
| BDL176 | 9891.2 | Av | | 1.17 | 1.06 | 1.22 | 1.14 | | 1.06 |
| BDL176 | 9891.4 | P | | <0.01 | 0.05 | | | | |
| BDL176 | 9891.4 | Av | | 1.23 | 1.11 | | | | |
| BDL176 | 9892.3 | P | | <0.01 | <0.01 | | | | 0.09 |
| BDL176 | 9892.3 | Av | | 1.34 | 1.17 | | | | 1.03 |
| BDL176 | 9893.2 | P | | 0.08 | 0.16 | 0.25 | | | |
| BDL176 | 9893.2 | Av | | 1.23 | 1.15 | 1.13 | | | |
| BDL176 | 9893.3 | P | | <0.01 | | 0.01 | 0.12 | | |
| BDL176 | 9893.3 | Av | | 1.2 | | 1.36 | 1.22 | | |
| BDL177 | 10521.3 | P | 0.03 | | | | | | |
| BDL177 | 10521.3 | Av | 1.43 | | | | | | |
| BDL177 | 10524.2 | P | 0.22 | | | | | | |
| BDL177 | 10524.2 | Av | 1.28 | | | | | | |
| BDL183 | 9941.1 | P | | | | | 0.58 | | |
| BDL183 | 9941.1 | Av | | | | | 1.1 | | |
| BDL183 | 9942.1 | P | | | | | 0.08 | | |
| BDL183 | 9942.1 | Av | | | | | 1.11 | | |
| BDL183 | 9943.4 | P | | | | <0.01 | | | |
| BDL183 | 9943.4 | Av | | | | 1.25 | | | |
| BDL183 | 9944.2 | P | | | | | | 0.29 | |
| BDL183 | 9944.2 | Av | | | | | | 1.24 | |
| BDL190 | 10232.2 | P | | 0.27 | | 0.54 | | | |
| BDL190 | 10232.2 | Av | | 1.14 | | 1.13 | | | |
| BDL190 | 10233.2 | P | | 0.38 | | | | | 0.03 |
| BDL190 | 10233.2 | Av | | 1.13 | | | | | 1.04 |
| BDL190 | 10233.4 | P | | 0.03 | <0.01 | 0.05 | | | |
| BDL190 | 10233.4 | Av | | 1.13 | 1.34 | 1.12 | | | |
| BDL190 | 10234.1 | P | | 0.21 | 0.03 | 0.53 | | | |
| BDL190 | 10234.1 | Av | | 1.16 | 1.03 | 1.19 | | | |
| BDL190 | 10231.1 | P | | | | 0.07 | 0.07 | 0.01 | |
| BDL190 | 10231.1 | Av | | | | 1.06 | 1.09 | 1.15 | |
| BDL190 | 10231.2 | P | | | | | | 0.33 | |
| BDL190 | 10231.2 | Av | | | | | | 1.4 | |
| BDL190 | 10232.2 | P | | | | 0.04 | | | |
| BDL190 | 10232.2 | Av | | | | 1.08 | | | |

TABLE 27-continued

Results from greenhouse experiments

| Gene | Ev. | Par | 31 | 32 | 33 | 34 | 35 | 36 | 37 |
|---|---|---|---|---|---|---|---|---|---|
| BDL190 | 10233.2 | P | | | | | | 0.25 | |
| BDL190 | 10233.2 | Av | | | | | | 1.25 | |
| BDL192 | 9921.1 | P | | 0.22 | 0.11 | | | | 0.07 |
| BDL192 | 9921.1 | Av | | 1.18 | 1.1 | | | | 1.03 |
| BDL192 | 9922.1 | P | | 0.01 | 0.04 | | | | |
| BDL192 | 9922.1 | Av | | 1.15 | 1.06 | | | | |
| BDL192 | 9922.2 | P | | 0.02 | 0.04 | | | <0.01 | |
| BDL192 | 9922.2 | Av | | 1.21 | 1.09 | | | 1.12 | |
| BDL192 | 9922.5 | P | | | | 0.68 | | | |
| BDL192 | 9922.5 | Av | | | | 1.1 | | | |
| BDL193 | 10152.2 | P | | | | | | | 0.08 |
| BDL193 | 10152.2 | Av | | | | | | | 1.04 |
| BDL196 | 10243.2 | P | | | | | | 0.01 | |
| BDL196 | 10243.2 | Av | | | | | | 1.14 | |
| BDL201 | 9963.6 | P | 0.15 | | | | | | |
| BDL201 | 9963.6 | Av | 1.28 | | | | | | |
| BDL201 | 9964.3 | P | 0.15 | | | | | | |
| BDL201 | 9964.3 | Av | 1.36 | | | | | | |
| BDL220 | 10333.5 | P | 0.35 | | | | | | |
| BDL220 | 10333.5 | Av | 1.19 | | | | | | |
| BDL223 | 10793.5 | P | 0.05 | | | | | | |
| BDL223 | 10793.5 | Av | 1.15 | | | | | | |
| BDL224 | 10451.8 | P | 0.02 | | | | | | |
| BDL224 | 10451.8 | Av | 1.5 | | | | | | |
| BDL225 | 10401.1 | P | 0.08 | | | | | | |
| BDL225 | 10401.1 | Av | 1.32 | | | | | | |
| BDL225 | 10401.4 | P | 0.01 | | | | | | |
| BDL225 | 10401.4 | Av | 1.52 | | | | | | |
| BDL225 | 10402.2 | P | 0.03 | | | | | | |
| BDL225 | 10402.2 | Av | 1.43 | | | | | | |
| BDL225 | 10402.5 | P | 0.26 | | | | | | |
| BDL225 | 10402.5 | Av | 1.39 | | | | | | |
| BDL225 | 10402.6 | P | 0.08 | | | | | | |
| BDL225 | 10402.6 | Av | 1.57 | | | | | | |
| BDL225 | 10402.9 | P | 0.12 | | | | | | |
| BDL225 | 10402.9 | Av | 1.36 | | | | | | |
| BDL226 | 10861.2 | P | 0.35 | | | | | | |
| BDL226 | 10861.2 | Av | 1.1 | | | | | | |
| BDL227 | 11492.3 | P | 0.05 | | | | | | |
| BDL227 | 11492.3 | Av | 1.15 | | | | | | |
| BDL233 | 10825.4 | P | 0.53 | | | | | | |
| BDL233 | 10825.4 | Av | 1.13 | | | | | | |
| BDL238 | 10954.2 | P | <0.01 | | | | | | |
| BDL238 | 10954.2 | Av | 1.34 | | | | | | |
| BDL240 | 10802.2 | P | 0.23 | | | | | | |
| BDL240 | 10802.2 | Av | 1.3 | | | | | | |
| BDL241 | 10873.1 | P | 0.07 | | | | | | |
| BDL241 | 10873.1 | Av | 1.29 | | | | | | |
| BDL242 | 10731.2 | P | 0.62 | | | | | | |
| BDL242 | 10731.2 | Av | 1.1 | | | | | | |
| BDL242 | 10731.6 | P | 0.04 | | | | | | |
| BDL242 | 10731.6 | Av | 1.21 | | | | | | |
| BDL250 | 10846.3 | P | 0.53 | | | | | | |
| BDL250 | 10846.3 | Av | 1.15 | | | | | | |
| BDL48 | 10271.1 | P | 0.2 | | | | | | |
| BDL48 | 10271.1 | Av | 1.23 | | | | | | |
| BDL48 | 10271.3 | P | 0.08 | | | | | | |
| BDL48 | 10271.3 | Av | 1.48 | | | | | | |
| BDL48 | 10273.2 | P | 0.58 | | | | | | |
| BDL48 | 10273.2 | Av | 1.12 | | | | | | |
| BDL48 | 10274.4 | P | 0.01 | | | | | | |
| BDL48 | 10274.4 | Av | 1.95 | | | | | | |
| BDL48 | 10271.3 | P | | 0.01 | 0.01 | | | | |
| BDL48 | 10271.3 | Av | | 1.12 | 1.1 | | | | |
| BDL48 | 10271.5 | P | | 0.06 | 0.1 | | | | |
| BDL48 | 10271.5 | Av | | 1.06 | 1.05 | | | | |
| BDL48 | 10274.3 | P | | | | | | <0.01 | |
| BDL48 | 10274.3 | Av | | | | | | 1.44 | |
| BDL48 | 10274.4 | P | | | | | | 0.08 | |
| BDL48 | 10274.4 | Av | | | | | | 1.05 | |
| BDL58 | 10282.3 | P | 0.63 | | | | | | |
| BDL58 | 10282.3 | Av | 1.19 | | | | | | |
| BDL63 | 10384.3 | P | 0.26 | | | | | | |
| BDL63 | 10384.3 | Av | 1.27 | | | | | | |
| BDL63 | 10381.1 | P | | | | <0.01 | 0.06 | | |
| BDL63 | 10381.1 | Av | | | | 1.26 | 1.08 | | |

TABLE 27-continued

Results from greenhouse experiments

| Gene | Ev. | Par | 31 | 32 | 33 | 34 | 35 | 36 | 37 |
|------|-----|-----|----|----|----|----|----|----|-----|
| BDL63 | 10381.2 | P | | | | 0.56 | | | |
| BDL63 | 10381.2 | Av | | | | 1.14 | | | |
| BDL63 | 10384.2 | P | | | | <0.01 | 0.04 | | |
| BDL63 | 10384.2 | Av | | | | 1.27 | 1.08 | | |
| BDL63 | 10384.3 | P | | 0.01 | 0.02 | 0.3 | | | 0.01 |
| BDL63 | 10384.3 | Av | | 1.12 | 1.09 | 1.15 | | | 1.04 |
| BDL63 | 10384.7 | P | | 0.05 | 0.06 | 0.08 | | | |
| BDL63 | 10384.7 | Av | | 1.07 | 1.07 | 1.15 | | | |
| BDL63 | 10384.8 | P | | | | 0.51 | | | |
| BDL63 | 10384.8 | Av | | | | 1.13 | | | |
| BDL81 | 10371.5 | P | | <0.01 | 0.01 | <0.01 | | 0.23 | 0.04 |
| BDL81 | 10371.5 | Av | | 1.13 | 1.1 | 1.15 | | 1.14 | 1.02 |
| BDL81 | 10371.8 | P | | | | 0.03 | | | |
| BDL81 | 10371.8 | Av | | | | 1.08 | | | |
| BDL81 | 10372.1 | P | | <0.01 | 0.01 | | | | |
| BDL81 | 10372.1 | Av | | 1.17 | 1.1 | | | | |
| BDL81 | 10372.2 | P | | 0.22 | 0.1 | 0.59 | | | |
| BDL81 | 10372.2 | Av | | 1.11 | 1.11 | 1.14 | | | |
| BDL81 | 10373.2 | P | | 0.05 | | | | | |
| BDL81 | 10373.2 | Av | | 1.07 | | | | | |
| BDL81 | 10374.1 | P | | | | 0.05 | | | |
| BDL81 | 10374.1 | Av | | | | 1.2 | | | |
| BDL85 | 10411.1 | P | 0.1 | | | | | | |
| BDL85 | 10411.1 | Av | 1.21 | | | | | | |

Table 27. Results of the greenhouse experiments. Provided are the measured values of each parameter [parameters (Par.) 31-37 according to the parameters described in Table 23 above] in plants expressing the indicated polynucleotides.
"Ev" = event;
"P" = P-value;
"Av" = ratio between the averages of event and control.
Note that when the average ratio is higher than "1" the effect of exogenous expression of the gene is an increase of the desired trait;

Example 10

Production of Tomato Transcriptom and High Throughput Correlation Analysis of Yield and/or Vigor Related Parameters Using 44K Tomato Oligonucleotide Micro-Array: Tomato Field Experiments In order to produce a high throughput correlation analysis, the present inventors utilized a Tomato oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 44,000 Toamto genes and transcripts. In order to define correlations between the levels of RNA expression with yield components, ABST or vigor related parameters various plant characteristics of 18 different Tomato varieties were analyzed. Among them, 10 varieties encompassing the observed variance were selected for RNA expression analysis. The correlation between the RNA levels and the characterized parameters in field experiments was analyzed using Pearson correlation test [Hypertext Transfer Protocol://World Wide Web (dot) davidmlane (dot) com/hyperstat/A34739 (dot) html].

Experimental Procedures

Growth procedure in tomato field experiments—Tomato varieties were grown under normal conditions (4-6 Liters/m$^2$ per day) until flower stage.

RNA extraction—Leaves at different developmental stages, representing different plant characteristics, were sampled and RNA was extracted using TRIzol Reagent from Invitrogen [Hypertext Transfer Protocol://World Wide Web (dot) invitrogen (dot) com/content (dot)cfm?pageid=469].

Approximately 30-50 mg of tissue was taken from samples. The weighted tissues were ground using pestle and mortar in liquid nitrogen and resuspended in 500 µl of TRIzol Reagent. To the homogenized lysate, 100 µl of chloroform was added followed by precipitation using isopropanol and two washes with 75% ethanol. The RNA was eluted in 30 µl of RNase-free water. RNA samples were cleaned up using Qiagen's RNeasy minikit clean-up protocol as per the manufacturer's protocol (QIAGEN Inc, CA USA).

Ripe fruit average weight (grams)—At the end of the experiment [when 50% of the fruit were ripe (red)] all fruits from plots within blocks A-C were collected. The total fruits were counted and weighted. The average fruits weight was calculated by dividing the total fruit weight by the number of fruits.

Experimental Results 10 different Tomato varieties were grown and characterized for ripe fruit average weight (grams) as described above and the measured parameter [Ripe fruit average weight (gr.) at Normal Irrigation] is presented in Table 28 below.

TABLE 28

Measured parameters Tomato accessions

| Variety | Normal Irrigation; Ripe fruit average weight (gr.) |
|---------|---------------------------------------------------|
| 612 | 0.05 |
| 613 | 0.01 |
| 617 | 0.01 |
| 618 | 0.05 |
| 622 | 0.01 |
| 623 | 0.01 |
| 626 | 0.03 |
| 629 | 0.00 |
| 630 | 0.00 |

TABLE 28-continued

Measured parameters Tomato accessions

| Variety | Normal Irrigation; Ripe fruit average weight (gr.) |
|---|---|
| 631 | 0.01 |

Table 28: Provided are the measured yield components (Ripe fruit average weight under normal irrigation) for the tomato accessions (Varieties).

Subsequent correlation analysis between the leaf transcriptom set of BDL83_H74 Gene (SEQ ID NO:282) and the ripe fruit average weight under normal irrigation conditions was conducted and the correlation coefficient (R) was found to be 0.734.

Example 11

Production of Tomato Transcriptom and High Throughput Correlation Analysis of Vigor Related Parameters Using 44K Tomato Oligonucleotide Micro-Array Experimental Procedures
Growth Conditions for Tomato Experiments
Correlation of early vigor traits across collection of Tomato ecotypes—Ten Tomato varieties were grown in 3 repetitive plots, each containing 17 plants, at a net house under semi-hydroponics conditions. Briefly, the growing protocol was as follows: Tomato seeds were sown in trays filled with a mix of vermiculite and peat in a 1:1 ratio. Following germination, the trays were transferred to normal growth solution [full Hogland; $KNO_3$—0.808 grams/liter, $MgSO_4$—0.12 grams/liter, $KH_2PO_4$—0.172 grams/liter and 0.01% (volume/volume) of 'Super coratin' micro elements (Iron-EDDHA [ethylenediamine-N,N'-bis(2-hydroxyphenylacetic acid)]—40.5 grams/liter; Mn—20.2 grams/liter; Zn 10.1 grams/liter; Co 1.5 grams/liter; and Mo 1.1 grams/liter), solution's pH should be 6.5-6.8] at a temperature of 20-24° C.

RNA extraction—All 10 selected Tomato varieties were sampled. Leaves from plant under Normal conditions were sampled and RNA was extracted using TRIzol Reagent from Invitrogen [Hypertext Transfer Protocol://World Wide Web (dot) invitrogen (dot) com/content (dot)cfm?pageid=469].

Tomato vigor related parameters—following 5 weeks of growing, plant were harvested and analyzed for leaf number. The analyzed data was saved to text files and processed using the JMP statistical analysis software (SAS institute).

Experimental Results
10 different Tomato varieties were grown and characterized for leaf number as described above. The average leaf number was calculated using the JMP software and values are summarized in Tables 29 below.

TABLE 29

Measured parameters Tomato accessions

| Variety | Leaf number |
|---|---|
| 1139 | 6.56 |
| 2078 | 6.89 |
| 2958 | 7.33 |
| 5077 | 6.22 |
| 5080 | 6.33 |
| 5084 | 6.44 |
| 5085 | 5.89 |
| 5088 | 5.56 |
| 5089 | 6.11 |
| 5092 | 5.67 |

Table 29. Provided are the measured vigor related parameter (leaf number) for the tomato accessions (Varieties).

Subsequent correlation analysis between the leaf transcriptom set of BDL83_H73 gene (SEQ ID NO:281) with the average leaf number was conducted, the correlation coefficient (R) was −0.794.

The genes identified herein improve plant yield in general, and more specifically oil yield, seed yield, oil content, plant growth rate, plant biomass, root measurements, and plant vigor. The output of the bioinformatics method described herein is a set of genes highly predicted to improve yield (seed yield, oil yield and content, biomass) and/or other agronomic important yields by modifying their expression. Although each gene is predicted to have its own impact, modifying the mode of expression of more than one gene is expected to provide an additive or synergistic effect on the plant yield, plant growth rate, root measurements, plant vigor and/or other agronomic important yields performance. Altering the expression of each gene described here alone or set of genes together increases the overall yield plant growth rate, root measurements, plant vigor and/or Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (1185 sequences)

SEQ ID NO: 1 - DNA, 1499 bp, Arabidopsis thaliana
aaaaagattcaataataagtgcacaagagaaattttgtcaggtttcaggcatagagcccagtaacactcaataacaaattcaaggaaaaaaataacaaaaccccatttcaactcaaatagcttcacagttttactaatctctctcatcttcttcccaacatcaaagaagacctttacttctggttagaatagaccaagaacactgagtacgacaaagaaccatgatgaatctttcttctcgtcgcgcctcttccactctcacattgagcttcactgttctccttttagcttccacaggttcgtatggctcaacattcacattcgctaatcggtgcggctacaccgtatggcctggaatcctatcgaatgctggctcacctactctctccaccaccggatttgagctccctaaaggcacctctcgctctctccaagctcccaccggttggtccggtcgattctgggctcgtaccggttgcaagttcgacagttctggctccggtacatgcaaaaccggtgactgcggctccaactctgtcgaatgcgccgggcttggtgccgcaccgcctgtaactctcgcggagttcactctaggcactggcggcgatgatttctacgacgttagtctcgtcgacggttacaacattccgatgatagttgaagtcgccggtggatctgggcagtgcgcttctaccggatgcactacggatcttaacattcagtgccctgctgagctgcgtttcggcgacggagacgcttgcaaaagcgcgtgtttagcgtttcggagtcctgaatactgttgcagcggcgcgtatgctacaccttctagttgtcggccttccgtgtattcggagatgtttaaagccgcgtgtcctcgctcctatagctacgcttacgacgatgctacgagcactttcacttgcgccggtggagattatacggtgacgttttgcccttcttcccctagtcaaaaatcgactagctactcccctccagtgacagactcgtcgtcgacctcacaaggttccgatcctgtgcctggttctgatactggttacgctggtcagggtcaacagactccaggtcaaggtaatgtgtacgggtcacaggggactgggtcggagatgggtacgggtgagaccatgttacaagacggatcatggatggctggtttggccatgggagaggcaagcagaccagccggcgtttcattgacagtgctgcttgctgcatttacttttccgtttattttctcgtagcatcatcgtctttagatttggtagtcgttttgttagcattgcctttgtttagtttttgttgatactcgatgattatcgcttaagactgcgacaatttgggttttaggcttttagggttttgcattgtagctttgtcgtgtacgcgcgtgtttgcttgtatcatctgtcattgaagattgtttatcatgttcgaaattgtgagatatgctttgtgatttaaagaaagatcttttgtggctt

SEQ ID NO: 2 - DNA, 1903 bp, Arabidopsis thaliana
actgcaactctttctcactttcactcaagattgcgtcactgtagtagtagtagtaatgtctcttcttcttctcttctgttgcttctttacctctctttctatttctcattctcatggagcttccactattcacatttctcctactcagcctcccgcagcttcttcggagaaaaccggttctgtaatgaaatttatagtagcagaggcaccattattaggacctgcaggtttcaacaaccctcaagtaattgaagttgcttcagtagctttagctgctcaaagaacatatagaaaagatcctctcaatggttttgagaaatatactggaggatggaatatcagcaaccaacattactgggcttcagtgagctatacagctgttcctctctttgttcttgctgctgtttggtttcttgggtttggcatctgtttattagtcatctgtatgtgtcacatttgccatagaaccaattctgttggatactctaaagttgcttatgttgtctccctcatcttcctcctcatcttcactgttattgcaataatcggatgtgttctgctatactcgggtcagataaggtataataaaagcacgacagagacattagagtatgtcatgagtcaagcagatagcacgatttcgcagcttagagctatctcagattatcttgcttcagccaagcaggctgcagttcttcaggttcttttacctgcaaatgtacaaactgaaatcgatcagatcggagtgaaactggattcttctgtagctactatcactgagaaatcgactaatagctccaatcacataagacattttcttgattctgtgagagtagcgcttattgtagtttcaatcgtcatgcttgtggtgacttttcttggtctcgtttcttcgattttcgggatgcaggtcatcgtttacacccttgtgatcttgggatggattctggtgactggtacattcatcttgagtggaacattccttgtgctacacaatgcaactgcagacacatgtgtggcaatgagcgaatgggttgagagaccatcaagcaatacggctctggacgagatattgccttgtacagacaatgccacagctcaggaaaccttgatgcgtagcagagaagtgacgggtcagcttgtggagctaatcaacacagtcatcactaatgtctccaacatcaacttctctccagtctttgtcccaatgtattataaccaatctggaccgttgcttccattgctctgcaatccttttaaccatgaccttaccgatcgctcttgctcgcctggtgatctcgatttgaacaatgctactgaagcatggaccagtttcgtgtgccaagtgagccagaacgggacttgcaccacaacaggaaggcttacacctgcgctgtacagtcagatggcatcaggtgttaatatcagcacgggattgatcagagacgcgccattcctggtccagcttcaggactgttcatacgcaaaacagacctttagagacataacgaatgaccattgtcctggactacagcgttatggctattgggtctatgtgggtctggccattttagcaacggctgtgatgctctcacttatgttctggatcatttacagtagagagcgaaggcatcggaaggaagctctgcctgaattttctgaaagtaaggagattgtaagagttaacttttgatgtatgtctctgtagatcttaagcaaaatgtttcaagtctcaagatacttgatttgtgctttcatgtctgaacatagtccactgagaaaaatgaaaatttagataccagtcaatgaaggagagtcttgtacttgttattacagtgaaatgtaaacacgaaacctttggttttctaaggttcttcgcatagatatatgcattaagattata

SEQ ID NO: 3 - DNA, 2661 bp, Arabidopsis thaliana
gtctcttggtaccttcctgctttctccttcctctcatttcccatataaagatcacttaagctcgtctcttcgtcttcacaaatcaccaatccatcttcttcttcttcctctctccttctccggccactttcctcactctctggtctccctatatcagcgctttttagctgatcctctctccggcatttctctctctctcttttttttagccatggagaaatttgcgcctgtcgctgctctgttactgcttcttctctgttttccggtagctttctccggtcatgattatggtcaagctctttccaagagtcttctcttcttcgaagctcagagatctggtgttcttcctcgtaaccaaagagtcacttggcgctctcactccggtctcaccgacggcaaatcaagcggcgtgaatctggtcggaggttactacgacgccggagacaatgtgaaatttggattaccgatggctttcacggtgacgatgatggcgtggagtgtgattgagtacgggaatcaattacaagccaacggcgagcttggaaactccattgacgccattaaatggggtactgattatttcatcaaagcccatcctgagcccaacgtcctttacggcgaggttggagatggcaacaccgaccattactgttggcagagaccggaagaaatgacgacggaccggaaagcttacaggatagatccgagtaatcccgggtcggatcttgccggagaaacagcagccgccatggccgccgcatcaattgttttccgccgatctaaccctgtttactctaggctactactcactcacgcctatcagttgtttgatttcgccgacaaatacagaggaaaatacgacagcagtatcactgttgcccagaaatactaccgatccgtcagcggttacaatgacgagttattgtgggccgctgcgtggctataccaagcttcgaacaatcagttctacttggactacttgggtcgcaacggtgacgccatgggtggtaccggttggtccatgactgagtttggttgggacgttaagtacgctggtgttcaaacccttgttgccaagtttttgatgcaaggcaaagcaggacgtcacgcacctgtgttcaggaagtatcaagagaaagctgattcctttatgtgttccttgttgggtaaaagctcgaggaacattcagaagacaccaggtggtttgattttcagacaacgttggaacaatatgcagtttgtcacaagcgcttccttcttgaccacggtttactcagattacctaacttcttctcgaagcaacttgagatgtgccgcgggaaatgtcgcaccttcgcagcttctttcctttgctaaatctcaggtggattatattcttggagataacccgagagctaccagctacatggttggttatggtaacaatttccctcagagagttcaccacagaggctcttccatcgtctctgtcaaggtggaccgtacatttgtcacctgccgaggtggatatgccacttggttcagccgtaaaggcagtgacccgaaccttctcactggtgctattgtcggtggccctgatgcttacgacaatttcgctgacaggagagataactatgagcagactgagcctgctacttacaacaatgcaccactccttggtgttcttgctcgtctcagcagtggtcattccggttatagccagtttcttccagtggttcctgctcctgttgtccgaagaccaatgcctattcgtagaccgaaagtgactactccagtccgagcttctggtccagtggctatagttcagaagataactagttcatgggtctcaaagggaaggacttactacagatactcaacaactgtgattaacaaatcttctagacctctgaaaagtctcaacctttcgatcaagaatctctatggaccaatctggggactctcgagatcaggcaactcgttcggtttaccctcgtggatgcactcattgccatccggaaaatccctagagttcgtctacattcactcaacaacacctgcaaatgtcgcggtatccagctacactttggcttgatcagacaacaacaacaacatcaaaggagatcacagtgtgtataggtcgtgagaagaagaaagtcgttggtttttacctctggttcgtcaagaacgttaaaaggtttagtcttttatcttcatttttacttttgggtttctctggtgaatattaaaaaagagggttgaagaagagttgaagaaaggtgtgaagagacaaagtgaagactcttcaaaaaattaaagaagagtgaaagtgctcatcctctttctcctctaagttcaatgcttttcaaaatttatatataaatcatatatagtaaaagagagaggaagatagagaaagatagtgtttgtgagatcttccttctcttaaagaaaaaggggtcttgtgagatattgcaaggattgtttttttcattccttgtagctcaaaacacatgtttatgtctttgtccttttgtgtttcatctttcttggtgggtctatggcagttgtaaaactcaacaacagtccttaatgatatgtgatttggtggttatcaatttatgttaggtatttgtcttctatacatacaactttgaaagattagtgatattcaaaaaagtg

SEQ ID NO: 4 - DNA, 1054 bp, Arabidopsis thaliana
cagaaacctgtctcatgacgttgtaataataataatatagcaaaatcaagaaacaacataattcactaaaaataaagtaagtaaaagaaagaaagaaagagatagtggctcaagtctcaaactcaatcaaaagcaccaaaccaaagttaccaaacttctcatcaccaaaagagagaagaagaagaaagaaacagagaatcgccatggcagagaaagagaagaaaacaaaaaagaagaagaagaaagagaagcatcaatcttccgacatctctttcaagccttcttcagacgtaaaaggactcaaattcggcggccaaataatcgtcaaatcattcacaatccgacgagcaagaacattcgagcttcttaaactcctctctctcccttcttcatcatcaccgccgcttctttccacggcggcttaccttccgacaaacttcacaatccttgcacaccacgcatggcacacactaacactaggtctcggaacaagaaagtccaaagttgtggtcttcgtgttcgaaacagaggcgatgaaatcatccgttgtggcggcggaaggaggaatctggccatcggagattccattgggagatgtgaacaagaagatgatcagaaagttaaagaactgggagatggcaaggtttaagttcagaaaaggttgtatcacgttttacgtttacgccgtgagaaacgccggaaatgaagggtttgcggcggcggaggacttaaaggtaatattacaagcggtggtggcattgaaagatttcatggatcacaccgcaatgcttgtaatgccccaccagaaaagtattaattacagctcttgtcctccttttgccatggctcactgaactttgaacaatattatacaagtgggccctcttctcttttttcttttctttttactccttttttttgttgatatagaaaaaaaagttcggattattatttatttttggttccataatggggttgtttgttattaatttcctgtatttttttctttgatttgggtggaagattgttggtatgaataagattaaaactgttg

SEQ ID NO: 5 - DNA, 3553 bp, Arabidopsis thaliana
accgcaaacatttgtgagagattccgagcgaaaaaaaccctagtgtacagtggcgtctttcttctccaactcgcttcttccctggctgattcggtttcttaaaagacctattactgattcttctgaggagactgacgttgaaggagattttgtaatggattctgctattgaaattagttcaggtagtgatagtgatgacgaagtaccaccgcagcctgtttggccacaaactcgaaccaggatggatcccacatggctaagcaggagacctttgcctacagtggatagccatgctagagctgaacatacaaatcaggctcctcccaatggtgcctcgagtgatacttctcggcctggagtctctaagcctttcacagggaatgggaacactgtaaactcgagaatttccagtggatctggtgctgattatgtgagactgtcttctgagcaagctctgaaaagaactcttccaccctcttttaattcccctccccttcctgccagaagtggcactaacaatataagtaatgctagtggaagtcgtgttggtgtggattatgagagaccattgtctcagcaagctctgaaaagaactcttccaccctcttttaatccccctccccttccttccagaagtggcacaaacaatatacgtaatgctggtgggagtcgctttggtgccgattatagtcatccagctgtgtcagctgtaggcaacaagagtacctttggtgatcattatagtggagcccatgctgagataggaattcaacgtggcgtgaatggggttaggatcctgcctccatctctgacgcatggaacatctgcttctgttttgcatcatgctggttcgagtgatccaatgcacaggtttggtggtggtgaagataggaatcctgataacgatgaaaggctggtttatcaggctgcactacaggttttgaatcaacccatgactgaaagtgatctacctcctggtactctttcagttcctcttatgaggcatcagaaaattgcgttggcatggatgtttcagaaggaaacaagtagtttcaactgtccaggagggatactagcagatgatcagggacttggtaagacggtctcgacgattgctcttatcctaaagcaaaagattgtgtcacaactgaagtccgaaagttcatgcaagcaagaaactgaggcattagtcctggatgctgatgatgagtcagacaatgcaaagcatgaaagtggtagtcatgtaaaaccagagctcaaggtttcaagcaacagtgagacctcggttctgagtgcatgtggtaatgatgagaatgacagttcagatatggagaaagccgaagatgaagaagctaattcttcaacacgagcatttcagtggaagagaccagctgctggtacattaattgtttgcccagcgagtgttgtaaggcagtgggcaagagagcttgatgagaaggtttctgaagaatccaaactttctgtgttagtctaccatggtagtaataggaccaaagatcctaatgaattagcagaatacgatgtggttgtgacaacgtacgctattgttactaatgaagctcccaacaaattcttggtggatgaggatgagaacgatgaaaaaaatactgacagatatggtcttgcctctggcttctccaacaataagaaacggaaagtcgtggtgggtgctagtaagaagagtaaaagaagaggtagaaaaagcactaacgatacttcttctgagcctgattgtggtcctctaggaaaggttgggtggttcagaatagtactagatgaagctcagacaattaagaactatagaacacaaatggcaagatcatgttgcactcttcgagccaaaaggaggtggtgcttgtctggaacaccaatacaaaatacgattgatgatttatatagctatttcaggtttcttagatatgatccatatgcggtgtacaagtcattttacagtacaatcaaggttccaatttccagaaattcttgtcaaggttacaagaagcttcaagctgttctaagggctataatgctgcgccgcaccaaaggaacattgcttgatgggaaacccataattaatctacctccaaaggtagtaaatttgagccaggtagacttttcagtggctgagcgctctttctacaagaagcttgaagctgattcacgttcacagttcaaggcctatgctgatgcgggaactttgagtcaaaactacgcaaatattcttctgttgcttttgcgactacgccaagcttgtgaccacccacaacttgttaaaagatataactcagatcctgttggaaaagtatcagaagcagcagttagaagactccctagggaggctcgaagcagactgatcaatcgcttagagtcatcatctgccatctgctatgagtgcaatgagccaccagaaaaacctgttgttacgttgtgtggccatatattttgctatgaatgtgttttagaatacataactggggatgagaacacgtgccctgtaccgagatgcaaacaacagcttgcgcgtgatgttgttttctctgaatcttctcttagaaattgcacttctgatgattcgggctgtagttcctctcatgataatggtcttgatagatcggtatttcaaaaaagagacttttgttcatcaaaaattaaagctgtcctcgatatcctgcagtcgctttcccaaccagacagtccaaactcagctcagcatggtcaaatgccatcttcctcacggccatatgatgacgatgatgttaccattgtagagccaatgcgtcttcactcatcttcacctagccagggggcagtaaagacgataatattttctcagtggactggtatgcttgacttggttgagctgcgtattcttgaaagtggtattgaattcagaagattagatggcacaatgagtctagcagcaagagacagggcggttaaagaattcagtaaaaaaccagatgtaaaggtgatgctgatgtcgctaaaagctggaaaccttgggctgaatatggtagctgcatgtcatgttattctcttggatctttggtggaatccaactaccgaagatcaggcgattgatcgtgcacatcgtattggacaaactcggccagttactgtaactcgcataactataaaagacaccgttgaggatagaattttgaagcttcaggaagagaaaaggacaatggttgcatcggcctttggtgaagaacatggtggaagctctgcgacacgtctaacagtagacgatctcaagtatctgtttatggtgtagactactcgttgtatggtctaagcgtagccttctaatcgcctcttgaactaggttgcttagtacagtacatatgggagatttagcccagaattttgatcaggaagaaacctctagctgcttttgtaatggatatccaatactgtggcactcctttggttttgtaaggtttgaacccaatctatgcatttttggtgtttccaaagtgcatcgattggaaacaggccataagtaaataactaaaatcggttcatggta

SEQ ID NO: 6 - DNA, 2202 bp, Arabidopsis thaliana
ggctttcagtttctccccttctccttcttctccgtctttggagctcaacaggggtttaaggattttctccgaaagctcaaaacttgagtgaaatttctctcattttacttatctgaagttcgtctacgatggaggaagagaaggtgagggttcgtctggtgtttgaagaccgacggattctgagtaagtatcaaaagaagcaaggtttaacacggagctgggttgttctaaatcgtaaatgtcaccgaactatatcagagttttctgatcatatctttcacacatttagcctctgtgaagcgtgtcctcatggcctctctctatctatggaaggtttcgttttgccacctttcgagtccagctgtgtattgaaggataaagatatcgtttgtgttaagaagaagaaagagtctttgttggagattgttggggaagacagtgatgagaatgtttacaacgctattgaggttgaggaaaggcctcagattcgtcctggtgaaatgctgcttgctaatgaggaattccagaaggaaactggaggatatgaaagtgagtctgaggaagatgagcttgaagaggaagcagaagagtttgtgccagagaagaaggcttcgaagaaacgtaaaacttcaagcaaaaaccagagcaccaagaggaagaagtgtaagttagatactactgaagaatctcccgacgaaagagaaaacacagctgttgttagcaatgttgtgaagaagaagaagaagaagaaatcattggatgtacaaagtgctaacaatgatgaacagaataacgatagtaccaaacccatgaccaaatcaaagaggtcatcacaacaagaagagagcaaagagcataacgatctgtgccaactatctgctgaaactaaaaagacacctagcagaagtgcccgacgtaaaaaggcgaaacggcaatggctgagagagaaaacaaaactagagaaggaagagcttctacagacgcagttggttgtagcacccagccaaaaaccagtcatcactatagatcaccaagcaaccaaggaaaagcactgtgaaactcttgaaaatcaacaggcagaagaagttagtgatggtttcggggatgaagttgtacctgtggaagtgaggccaggccacatacgcttcaagcctctcgctggaacagatgaagcctctcttgatagtgaacctcttgtggaaaatgtcttgtggaatggaaacatgacgaagaagaagggacagaaatggggcacagagaagtcagggttttccaaacgatatgctcaggattttaatgaagatgctacgacacagcccgctgaagcagagacacttgctaattgtccgattgattatgaacagcttgtggcttacactggctcagtaaagaaaggagatgttattgcataccgcctcattgagttaacatcatcttggacacccgaggtttcctcttttcgggttgggaagataagctactatgatccagactccaagatggtgactttgatgcctgttcaagaatttccaatcgagaaaaagacagaagaggacgacgatttctgtatgcaacctgatacatctctttataaagaagatggatccctggagatagaattttctgctctgctcgatgttcgcagtgtcaaaactagcagctcagattctgcagaagtcgccaagtcagcactgcccgagcctgaccagtcagctaaaaagccaaagctaagcgcaaacaaagaattgcaaacccctgcaaaagaaaatggagaagtgagcccttgggaagaactaagtgaagctttaagtgcaaagaaagcagcgttgtctcaggccaacaatgggtggaacaagaaagggagttcaagtggaggctcatggtcttacaaggcactgcgaggcagtgctatgggtcctgtaatgaactatctcagatctcagaaagagatttgagaaactaggtcacatctctctagaagaaactctgctgcttttgtcttcattttggatatgaaaaactcagacaaagggtagagaaagccattttgtttttgatgctgtaaacgcacagtttagctttctaaggttaaaggtttatgtatagagaaaaacgatgaatgtgtaatactctctcaagatctttttgaatttcacgtttgaatccattcaaaaatctgaaaaatgaatgtgttatatatca

SEQ ID NO: 7 - DNA, 1319 bp, Arabidopsis thaliana
ggtcgcgtctttatcctctcatcatcatcctcgaaacgtgcaacacacaaaaaattgactataaaagattgcaaatttctctctaaatatctgattcaaacgcatttggtaggctgagagaaagaaagaaaaagataaagatggatcacgcagcagatgctcaccgtacggatttgatgaccattacaagattcgtgttgaatgaacaatcaaagtatccagaatctcgtggtgatttcaccattttgcttagtcacatcgttttgggttgcaaattcgtttgcagtgctgttaataaggctggtttggctaagttaattggacttgcaggggaaacaaacattcagggtgaagagcaaaagaaacttgatgtgctctctaatgatgtctttgtcaacgctttggttagcagtggtagaacttctgttcttgtctcggaggaagatgaggaagctacgtttgtggagccatccaagcgtggaaagtactgtgttgtttttgatccgcttgatggatcttcaaacattgactgtggtgtttccattggcacaatttttggaatttacacgttggaccacactgatgagccaaccactgcagatgttctgaaacctgggaatgaaatggtggctgcaggttattgtatgtacggaagctcctgcatgcttgtgttgagcactggaaccggtgtccacggatttacactggacccatctctaggagagttcattctaactcacccggacattaagattccaaataagggaaacatttattcggtgaatgaaggcaatgcgcagaactgggatggtccaactacaaagtatgtagagaaatgcaagtttcctaaagatggttctcctgcaaagtctctgagatacgtaggaagtatggtagctgatgttcatcgtacactactttatggaggaatcttcttgtacccggctgacaagaaaagccccaatggaaaattgcgtgtcttgtatgaagttttcccgatgtcgtttttgatggagcaagccggaggtcaggcctttacgggaaagaaaagggcgctagaccttgtcccggagaagatccatgagcgttctccgatatttcttggtagctacgatgatgtagaagagattaaagctctctatgctgaggaggaaaagaagaactaagcttctcattcttcttttattctcttactgtctctgtctctcttatttctatatacagtatcttcttctgatgagaagaacaatataactcatttacaaaaggaagatctttctttatcattaaatgcacataaaaatcttctttctttcata

SEQ ID NO: 8 - DNA, 5833 bp, Arabidopsis thaliana
gcatttggagtttcctgacagcgagagttgctcgttttctggggtcacaacagaagaattcgagcttggaagattgaaatttgagatcttttgatcttgaatcaagcataaattctggattttgaagtttgagagtgacccagtgactttggtctgaatctcggaggtatcttattccagggatcaaggattagacttaatgcgattaagcaaatgggtttttcacgatgactctccttgttgttggggagattcaataaatggactcacaagatcacaaagcacctggctttgttgacatagtcaaatcttggatccctagaaagagtgagtcctcaaatatgtcgagggatttttggatgcctgaccaaagctgtcctgtgtgttatgagtgtgatgctcagttcactgtgtttaatcgaagacatcattgccgcctttgtggtcgagttttttgtgccaaatgcgctgcaaattccattccatctccatcagatgaaacaaaggatagtcatgaggaaccagaaaggattagggtgtgtaattactgctacaaacagtgggaacaggggatagttccccctgataatggggcttctattattagccttcattttagttcatcgccttctgctagaagcgtcgcaagtactacctctaatagtagcaactgcaccattgattcaactgctggaccttcccctagacccaaaatgaatccccgagctagccgtcgtgtctcgtcaaacatggattctgaaaagtctgagcagcagaatgcaaaatcgcgtaggagctcagatcattatgggcatgtgttagattcttctgataatcaagttgaattctttgtcaacagtagtggcaggagtgatggtgaagctgatgacgatgacgattatcaatctgattttgcacaatcttacgctcaaggaaatgactactatggtgccatcaacctcgatgaagtagaccatatctatgggtcacatgaagctcatgacgttggtgtaaaaatagaaccaaacataagtggctttccccctgatcaagatcttgactcactgaatacagagacgatagataaaaccagacaccaagaaaatggatggaccgatgtaaaggagggaagccctccttgtgaagagtcctttgagcccgaagttgttgattttgagagtgatgggctcttatggctaccaccagagccagagaacgaagaagatgaaagagaagcagtgctatctgatgatgacggtgatgaaggtgatagaggtgattgggggtaccttcgcccatcaaatagctttaacgagaaggatttccactctaaggacaagtccagtggtgctatgaaaaatgttgttgaagggcactttagggctttggtagcacaacttttggaggttgataatctacctatggtcaacgaaggtgatgaagagggctggcttgatataattacatcattatcttgggaggctgcaacgcttctcaagccagatacaagtaaaagtggaggaatggatccaggaggatacgtgaaggttaaatgcatcccttgtggacgtcgcagtgagagtatggtcgtgaaaggagttgtttgtaagaaaaatgtggctcatcggcgaatgacttcaaagatcgagaagccgcgtctgctaatccttggaggagctctggagtatcagcgcatctctaaccagctgtctagttttgacactttgttgcaacaggaaatggaccatttgaagatggctgttgccaaaattgattctcacaatcctgacattctcttggtggagaaatctgtctcgcggtttgcgcaggaatatcttctcgcgaaggacatatctctcgtgttaaatattaaaaggtcccttctagagcgcatatcccgctgtactggtgcgcagattgtcccttcgatcgaccagctcacatcaccaaagctaggttattgtgacctgttccatgtggaaaagtttgtggagacacatgttagtccttgtcaagttgcgaagaaaatggccaagactttaatgttttttgatggctgcccgaaacctttgggttgtacaatattgctcaagggggcacatgaagatgagctaaagaaggtgaaacatgtgattcagtatggagtttttgcagcatatcacttggctcttgagacatccttcctagcagatgaaggtgcttccattcacgaacttcctctgcagaccccaattactgtggcgttacctgataaaccatcaatggttaacagatcaatatccacaatacctggttttactgtgtcaagtgctgaaaagtctccaactactgagttaaggggtgagccacataaagccaatggcgaccttactggtaatttcacttctagtaagactcatttccaagggaaattggatggaaacgacaggattgacccatctgaaagactgcttcacaacttggatactgtttactgtaagcctccagaaactattacctctaaggacgatgggttagttcctactctagaatccaggcagctatcatttcacgtggaagaaccttctgttcaaaaagatcagtggtctgttttatccggtgccacagaacaagtaacagatggtggttacacgaatgactccgcagtaataggaaatcaaaattttaatagacaggaacaaatggaatcttcaaaaggagactttcatccgtcagcttctgaccatcaaagtatattggtttccttatcaacaagatgcgtatggaaaggatctgtgtgtgagcgggctcatctactccgtatcaaatactatgggagctttgacaagcctttaggacggtttttaagggataatctctttgatcaggatcagtgctgcccgtcatgtacgatgccagcggaagcacacattcattgttatactcataggcaaggtagtctgacaatatctgttaagaaactgcctgaattgctacctgggcaacgtgaagggaagatttggatgtggcatcggtgcctgaaatgtcctcggatcaatggctttcctccagccacacgcagaattgtaatgtcagatgctgcgtggggcctgtcttttggcaaatttttggagctgagcttttctaaccatgcagcggctagtcgtgtggccaactgtggtcattcccttcacagagactgtctccggttctacggttttgggagaatggttgcttgcttccgctatgcttcaatcaatatttacgcagtgactctgccaccagcaaagctttattttaactatgagaaccaggaatggctccaaaaggaatcaaaagaggtgattaaaaaagcggaagtcctttttaatgaggttcaggaggctcttagtcaaatttcagcgaaaactatgggcgcaggttccaagggcagcactcccaacaagatcaagctttctcttgaagaacttgcaggacttcttgagcaacgtaaaaaggaatataaggattcattgcagcaaatgttaaatgtggttaaggatggacaacctactattgatatccttctgataaataaacttcgaaggctgataattttcgattcatatgcttgggatgaatgcctagcaggggcggccaatatggtaagaaataactatttggaagctccgaagaattcagccccaaaagttatgggtcgtaacgtctccttagagaagctcagtgatgaaaaagtaaagtcgataccgacccatgttgcaatttgtaatgactctcttctccaggatgcagactacgaaacgtgtcttaaccaaggtaaatcatttgctgatactagtggcaaatttgctattcctgaagatgtaggctcagacagacccccagattgtaggatggagttcgaccctagtgaaggtggtaaagataattttgtagagtcttcgcaggtggttaaaccagcacacaccgagagccagtttcaagcaacagacttatctgatactcttgatgcagcatggataggtgaacaaactacttcagagaatggtattttccgtccgcctagcagagctgcttcaacaaatggaactcagatccctgatttaaggctgttgggttcagaaagtgagctgaactttaaaggaggccctaccaatgatgaacatacaacacaagttcagttgccttctcctagtttctactattcactcaacaagaattattcgcttaattctcgcaagcatatcatggctgaagaccggcctgtttatgtttcttcatatagagagcttgaatggcgaagtggtgcaaggctgctgcttcctctgggatgtaatgacttagtactgccagtttatgatgacgaacctactagtatcatagcttatgcccttacatcatcagaatataaagctcagatgtctggatcagataagtcaagagatcgcttggatagtggaggttccttttcactttttgattctgttaatcttctctcattgaactctttgagtgatttgtcggtcgacatgagtagaagtcttagctctgctgatgaacaagtctcgcagctgctacattcatcactgtatttgaaagatctgcatgcgaggatttcgtttacagatgaaggtcctcctgggaaagtgaagtactctgtgacgtgttattatgctaaggagtttgaagccctgaggatgatttgctgtccttcagaaacagatttcattagatctcttggtcgttgtagaaaatggggagcccagggtggaaagagcaacgtcttctttgcaaaaagtttggatgaccgttttatcatcaagcaagttacaaagacagagcttgagtccttcatcaaatttgggccagcttacttcaaatacctgactgagtccatcagtactaaaagccctacaagccttgcaaagatcttgggaatctatcaggtttcatccaaacaccttaaaggaggaaaagagttcaaaatggacgtcttggtgatggagaatcttctgttcaagcgaaacttcactaggctttatgacctaaaaggctccactcgggctcgttacaatcccgatacaagtggtagcaatacagttttgctggatcagaatcttgtcgaagcaatgccaacatctccaatatttgttgggagcaaggcaaaacggcttcttgaaagagcagtctggaatgatacatcatttcttgcttcgattcacgtaatggattactccttactagtcggggtagatgaggaaagaaacgagctggttctaggaattatcgatttcatgaggcaatacacttgggacaaacatctggagacttgggtcaagacttcagggctccttggaggacccaagaactcaactcccacagtgatatcgccgcagcaatacaagaaaagattcaggaaagcgatgacggcttattttctgatggttcctgaccagtggtcgcctgccgcggttgtgccaagcaacagttcttcagcagaggtgaaggaggaagaagagaaagacaatcctcaagctgttggtaacaagtcctgaagtattttcagcaaacatacacaatattcagttagcaaatatagtttttattttttttggttggaatggtcttttgggtaatttgtgtttatgtattacccttggccttaagtgtggcatatgcctcttccatcgcctttgcatcagaattaataaaagaaagatgcaattgtacagacactgcttctatcttttagtgtttgttattcgtcgtaacttatgtttttatcaacaattcttcttggttagtctttcaaatgctctcaaatcattttattaaatttctcgaacgtttgttt

SEQ ID NO: 9 - DNA, 6992 bp, Arabidopsis thaliana
gctttatactttgttgagtcaaaatcacagacgaagaagaagaagaaacctctctctcactcctctctcctttctctcgtcttattcgcttctcttctacgtaacagattgttcatcttcttctccttgttgcattgagggggtgttgttgatgttctgacgatctgatttgagtagatctgggtagggggcaaggtctctgggtctacttttgatttgagaattttttaagtgaagtgaagatatgacaagtgctcttggatggagatttccttccactaatggaaatggccttgccccaagtgacacggagagaaatggggatatgaagatgcatgattcagagcccccaactccacattcaaccacaaagatgagtttgagagaccggacaaccagcatggaagatccagatgggacattagcaagtgttgcccaatgcattgagcagctgcgccaaggttcatcatctgcacaagaaagagaatattgtctgaagcagttactggaccttatagaaatgcgtgagaatgcattcagtgctgtcggatcacactcccaagctgtgccagtacttgtctctcttctccgatcgggatcagttggagtgaagatacaagctgcaaccgtcttgggttcactctgcaaggagaacgaacttagagttaaggtgttacttgggggatgcattcctccattgcttggtcttctcaagtccagttcagtcgaagggcagatcgctgcagcaaagacaatctatgctgtttctgaaggtggggttaaagaccatgttggatcaaaaatattttccactgagggagttgtaccggttctgtgggaccaattgcgcagtggaaataaaaaaggagaggttgatggtttgttaactggtgcacttaagaacctttctagtaccacagagggattttggtctgagacaattcgagctgggggagtggatgtacttgtgaagctgctcacaagcgggcagtcaagtacactatctaatgtctgcttccttcttgcgtgtatgatgatggaagacgcctctgtttgttccagtgtattgactgcagacattacaaaacagcttctcaaattattaggatcgggtaatgaagccccagtgagggcagaggctgctgctgctctcaagtcgctttctgctcaatctaaggaagcaaagcgggaaatcgctaattctaatggtattcctgttttaataaatgcaacaatagctccatctaaagaattcatgcaaggtgaatatgcgcaagcattacaagaaaatgcaatgtgtgcccttgctaatatttccggtggtttgtcatatgtcatatcaagccttggtcagagccttgaatcttgctcttcgcctgctcagactgccgacacccttggggctttagcttcagcattgatgatatatgatggcaaggcagaaactacaagagcatcagatccattggtcgttgaacagactctgctgaagcagtttaagcctcgtctaccattcttggtgcaagaacgtacaattgaagcacttgcaagtttgtatgggaattccatactctctgtcaaactttccaactcggatgcaaaacgtttgcttgttggtctaataacgatggcggtgaatgaggttcaagatgagcttgtaaaggctcttctgatgctgtgtaaccatgaaggtagcctgtggcaagcactacagggccgtgaagggatccaattgctaatatctcttttgggtctttcatccgaacagcagcaagaatgtgctgttgcacttctttgccttttgtctaacgaaaatgatgaaagcaagtgggccatcactgctgctggaggtatacctccacttgttcaaattctagagactgggtcggccaaagccagggaagactctgcaactatccttaggaacttgtgcaatcatagcgaagatatacgtgcttgtgttgaaagtgcggatgctgtccctgctctcttatggctactaaagaatggtagtccaaatggtaaagaaattgccgccaagacattgaatcatttgattcataaatcagatactgcaactatcagtcagcttactgctttgctgaccagtgatctacctgagtctaaaatttacgttttggatgcattgaagagtatgctttctgtggtcccattcaatgacatgctacgtgaaggcagtgcttccaatgatgctattgagacaatgatcaagttgatgagctctggtaaagaagaaactcaagcaaattcagcatcagctcttgcagctatcttccagagcagaaaggatttgcgtgagagtgctctagccctcaaaactctcttgtcggccataaaactgttaaatgtggattcggagaggatccttgttgagtcttgccgctgcctggctgcaattttactttcaattaaggagaatcgcgatgtggccatttctgccagagaagcattgcctaccatagtatctctagccaactcttctgttctagaagttgctgagcaaggaatgtgcgctttggctaatcttatattggacagtgaagtgtcagagaaggtcattgtcgaagatatcatcttgtccgccactagaatcttacgtgaaggtacagtgtctgggaagacacttgctgctgcggcaattgcccgcctccttagtcgtcgccgaattgattctgcattgacagattctgtgaaccgagctggaacagtgcttaccttagtgtctcttctagaatctgccgatggaagatctgatgcaatatcagaggccctagatgcgcttgctatattctcaaggtcaggagctaatggaaatgtaaaaccagcttgggctgttttggctgaatctcccaacagtatggccccaatagtctcatctatagtgagtgttgctaatccttcactacaggacaaagctattgaagttttgtcaagactttgccgagatcagcctattgttttgggaaacatggtcaacaatgccagagattgcgtgtcatctatagctaaaagggtgataaataccagggacccgaaaataaaaattggtggagctgctattattatctgtgctgccaaagttgacgaccagaagatgatagaaaatctgaatgagacacaattgtgtgccaaattcgttcaagcacttgtggggatcctagattctgtgcaagatcaggaaaaggatgagaaagataaaatctgcatatgcattcatcccaaagaaaaggaagaagatgaagaagaagaggcaacagaaaatagggagggttccacgggggcaacagttatttctggagacaatttagccatctggttgctctcggttctttcttgtcatgatgaaaagagcagagcagtaatattggagtcagaaggcattgagttgattactgacagaataggcaaccgttttctccaggctgataatggagaagatgccaacatttgggtttgtgctttattgctggccatacttttccaagacagagaaatcactcgcgcacatgcaacaatgaaggctgttccagtgctctcaaatcttgtgaagtcagaggaatacgcagacagatattttgcagcacaagctctagctagtcttgtctgtaacggtagtcgcggaactcttctatctgttgcaaactccggtgctgcggctgggtttatatcattgcttggttgttctgatgatgacataaaagaacttctgcagctgtcgcaggagttcactttagtgcggtacccagaccaggttgcccttgaaaggcttttccgagttgaagatattagagttggggctacttctcgaaaggcgattcccttactagttgaacttcttaaaccaattccagaccgccccggtgctcctctactttcacttaatcttctaactcagcttgctggggactgtccacaaaatatgattgtcatggtagagtcaggtgctcttgagggtctctcgaaatatctttcccttggacctcaggacgagcaagaggaagctgcaacaggtcttttaggcatcttatttagcagtgctgaaattcgaaggcatgagtcagcatttggcgcggtcagccaacttgtagctgttttgcgtctaggtggaaggggggcaaggtacagtgccgccaaggcattggatagtctctttactgctgaccatataagaaatgcagagtcttctagacaagctgttcagccattggtagagattctcaacactggttcagagagggagcagcatgctgctattgctgcacttgttaggttgttgagtgataatccatcacgggctctggcagttgcagatgtggagatgaatgcggtggatgttctctgcaggatcctttcttcaaactatacgatggaactgaagggagatgctgcagagctgtgttatgttctgtttgcaaatacaaggattagatctacagttgctgcagcgcgttgtgttgagccacttgtctctcttcttgtgactgagttcagccctgctcagcattcagttgtgcgtgcactggacaagcttgtcgacgatgaacaactggctgaactagttgcagctcatggcgctgtggtacctcttgttggccttctctatggtaaaaactatgtgcttcatgaggctatatccagggctctagtaaagttgggtaaggacaggcctgcttgtaaactggaaatggtgaaagctggagttatcgactgcgtacttgatattctccacgaagctccagattttctatgtgctgcgttttcagaactgcttcgaatcctcacaaataatgctactattgccaagggacaatctgctgcgaaagtggtggagccacttttccatttgctgacgaggttggagtttggagctgatggacagcacagtgctctgcaagttctggtaaatatcttagaacatccacaatgccgcgctgattatacacttacaccgcaccaagtaattgagcctttaattccgctactggaatctccatccccagcagtccagcagttggcagctgagcttctatctcatcttctctacgaggagcatctgcagaaagatccattaacgcaacttgcgattggtcctctaatccatgtgctgggatccggcatacacctattacagcagagagctgtgaaagctctcgtcagcattgctctaacatggccaaatgaaatagctaaagaaggtggtgtgagtgagctgtcaaaggtgatactgcaagctgatccatcgctctccaatgtgttatgggagtctgcagcatcaattttggttatcatcttgcaatttagctccgaattttacctggaagttcctgttgctgttcttgtaagactgcttcgttctgcatctgaaaacaccgtggttggtgcacttaacgctcttctagtgttggaaagcgatgatggaaccagtgcagagtccatggctgaaagtggtgccatagaagctctgcttgatcttttaaggtctcatcagtgtgaggacacagcagcgagactgctcgaggtactgctcaacaacgtgaagattagagattcaaaagccaccaagactgcaatcttgccattgtctcagtacctcttggatccacaaactcaagctcagcaggcgcggttactagcaactttggcccttggtgatcttttccagaatgaagctcttgctagaagcaccgatgcagcttctgcttgccgtgctttagtcaatgtccttgaagaacaacccacagaagaaatgaaagtagttgctatatgtgctctgcaaaatctcgtcatgtatagccgatctaacaaaagagcagttgccgaggcaggtggtgtgcaggtcgtcttggatctgatcagttccagtgatcctgaaacgtctgttcaggctgcaatgttcgtaaaactactcttctctaatcacaccgttcaagagtacgcatctagcgaaaccgtcagagcaataactgctgccattgagaaagacttatgggccactggaaccgtgaatgatgaatacctaaaagccttaaactctttgtttaacaacttcccgcgtctaagagctacagagcctgcaacactaagtataccacatctagttacatccctcaagacaggatcagaagcaacacaagaagctgccttggatgcattgtttcttctcagacaagcttggtcagcctgtcctgccgaagtttccagggcccaatcagttgctgctgcagacgccatccccctacttcagtacctaatccaatcaggtccaccacggttccaggagaaagctgaattcctcttgcagtgtttgccaggtactctggtagtcactatcaaacgtggtaacaacatgaagcaatccgttggtaacccgagtgtgttctgcaagataacactcggcaacaatcctcctagacagaccaaggtgatatcgacaggtcctaatccagagtgggacgagagcttctcatggtcatttgagagccctcccaaaggtcaaaaactccacatttcatgcaagaacaaaagcaaaatgggaaagagttcctttgggaaagtaacgatccaaatcgatagggtggtgatgctgggagcagtcgcaggtgaatatagtttgttaccagaaagcaaaagtggtcccagaaaccttgagatagaattccagtggtctaacaagtaaaccaccacttcattttttgtttttgtttgagaggtttcttaaatcgaaacttctgcttcatttttttgccaaattttttaaaaatcgtttgatttataatgctactgtatatagttggtattgtaatgtaatgattacagtttacaaatgttttttttttatcttctttttttcttaactgtgtgtttactgattcaattcatttgtaacattttgttgtcctcatttgtatgttatgtatcttcatatttgttcatcttttggtgtgcctataaagtttaaactttaacgatgt

SEQ ID NO: 10 - DNA, 5805 bp, Arabidopsis thaliana
atggaagctagttcgagtggaacggcggagttgccgcggtctctttctcggagagctccgtcgcgtgcgactactatgatgattgatagaccaaacgaagatgctagtgctatggatagcgagcttgttccttcctctctcgcttctattgccccgattcttcgcgttgctaatgaaattgagaaggacaatcctcgagtggcttatctatgccggtttcatgcgtttgagaaagctcataggatggatgctacatccagtggacgaggtgttcgtcagtttaagacctatctgttacatagacttgagaaggaagaagaggaaaccaagcctcagctggcgaaaaacgatcctagagaaattcaggcatattaccagaacttctatgagaaatatattaaagaaggagaaacatcaagaaaaccggaggaaatggcaaggctttaccaaattgcatcggtattgtacgatgtactgaagactgtagtaccttcacctaaagtggattacgagacccgtagatatgccgaagaagttgaaaggaaaagggatagatatgagcactacaacattcttcctttatatgctgtagggactaaaccagcaattgtggaacttcctgaggtcaaggctgcattcagtgctgtccgtaatgtgcgcaatcttccacgacgaagaattcatttgccatctaatacccctaatgaaatgcgtaaggctagaaccaaacttaatgacatacttgaatggcttgcttctgagttcgggtttcagagagggaacgtggcaaatcagagggagcacataatactgcttcttgctaatgctgacattagaaagagaaatgatgaagaatatgatgagttgaaacctagcaccgtcactgagttgatggacaaaacttttaaaagttattactcatggtgtaaatatttgcactctacgtctaatctcaagtttccagatgattgtgataaacagcagctgcagcttatctatatttccctgtaccttttaatatggggtgaagcctcgaatgttagatttatgcccgaatgtatctgctatattttccataatatggcaaatgacgtctatggaattctgtttagcaatgttgaagctgttagtggtgagacatatgaaacagaagaagttattgatgaagaatcatttctgagaactgttataactccaatctatcaggtcatacgcaacgaagccaaaaggaacaagggaggtacagcaagccattcgcaatggagaaattacgatgatttgaatgaatacttttggtctaagaaatgcttcaagataggatggcctcttgaccttaaagcagactttttcctaaactctgacgagataaccccacaggacgagaggctgaatcaagtcacttatgggaaaagcaagcctaaaaccaactttgttgaagtccgcacattctggaacctcttcagagattttgatcgaatgtggatatttcttgtcatggcttttcaggctatggtaatagttggatggcatggttctgggtcactaggtgacatatttgacaaggatgtattcaaaacggtgttaactatttttattacttcggcgtatctgactcttttacaagctgcactggatattatcctaaatttcaatgcctggaagaatttcaagttttcccagatattgcggtaccttttgaaattcgcagtagcatttatgtgggcggtactgcttccaattgcttactcgaagtctgttcaacgcccaactggagttgtaaagttcttcagtacttggactggggattggaaggatcagtccttttatacgtacgctgtttcattttatgtgttaccaaacatattggcagctctgttattcctcgttccaccattccggagagccatggagtgttcagacatgcgacctatcaaagttataatgtggtgggctcaggcaagtattaaactattcttctggttcttgagtatactgccaaaactatacgttggaagaggtatgcatgaggacatgttctctctcttcaagtataccaccttctggatcatgctactgatcagcaagcttgctttcaactattatgtggagatactaccccttattacgccaacaaagatgatcatgaatctgcacattggtcactaccagtggcatgaattttttccccatgcaactaacaatattggagtggttattgctatatgggctccaattgtactggtttacttgatggatactcaaatatggtacgccattttttccactctgtttggaggcatacatggggccttcagtcatctgggagaaatacggactcttgggatgttgcgatctagatttgagtcaataccaattgccttcagccgcaccctcatgccatccgaagatgcaaaaagaaaacatgcggatgactatgtggaccagaaaaacatcactaatttctcccaggtgtggaacgagttcatttactctatgagaagcgaggataagatcagtgacagagatagggatttgctgcttgtaccatcttcgtcgggtgatgtgtctgtcatccagtggccacctttcttgcttgctagtaagattcctattgctgtggacatggcaaaagatttcaagggaaaagaggatgctgaactatttagaaagattaagagtgatagctacatgtattatgctgttattgagagttatgagacattgaagaaaataatttacgctcttctggaagatgaagcagatagaagggtcatgaatcaggtatttttagaagtggacatgagcatgcagcaacagagattcatatatgaattccgcatgagtggattaccgctccttagtgataagctggagaagtttctaagtatattgttaagtgactatgaagaccagggtacatacaagtctcagttaattaatgtcttccaggatgttatcgaaattatcactcaagatctcttggttaatgggcatgaaattcttgaaagggctcgtgttcattctcctgacatcaaaaatgagaaaaaggaacagaggtttgagaaaattaatatccacctagtacgggatagatgttggcgggaaaaggttattcggcttcatttgctcttatcggtcaaagaatctgcaataaatgttcctcaaaacttggaagcccgccgacgtatcacattctttgctaattctctgtttatgaatatgcctagtgctccaagaatacgagatatgctatctttcagtgttttaactccttactacaaagaagatgtgctgtattcagaggaagaccttaacaaggaaaatgaagatgggatctcaattctgttttatctacaaaagatttatcctgatgagtggaccaattatttggatcgcttaaaggatcctaagcttcctgagaaagacaagtcagagttccttcgagagtgggtatcttacagaggtcagacgttagccagaacagttaggggtatgatgtactatagacaggctctggagcttcaatgctaccaggaagttgcaggggaacaagccgagtttagtgtctttcgggccatggcgtccaacgatgaaaatcagaaggctttcctggaacgtgccagagctcttgcagatctgaagttcacttatgttgtttcttgtcaggtctacggaaatcagaaaaagtccggtgatatccacaaccgcagctgctacacgaatattctgcagctcatgctaaaatatccatcattgcgggttgcttatgtagatgagagggaggagacagcagatgcaaaatctccgaaggtcttttactctgtacttctaaaaggaggtgacaagtttgatgaggaaatttaccgcatcaagcttcctggtcctccagctgagattggtgaaggaaagcctgaaaatcaaaatcatgctatcatatttacacgtggtgaagcactacaaactatagatatgaatcaagacaattactttgaagaagctttcaaactaagaaatgtattggaggaattcaataaggagcgtgttggtagacgcaagccaacaatattgggtctccgagaacatatatttactggaagtgtttcgtcattagcttggttcatgtccaatcaggagagtagttttgtgacaattggccaaagaattttggcaaaccctctgagggtccgttttcattatggtcatcctgacatatttgacagaatctttcacataacaaggggcggtgtgagcaaggcttcgaaagtaataaatttgagtgaggatattttcggaggcttcaattcaactctccgtggaggatatgttacacatcacgagtatatccaagttggaaagggacgggacgtggggttgaacccaatctctatttttgaagcaaaagtagcaaatggaaacggggagcaaacgctaagccgtgatgtttaccgtttggggcatcggtttgacttttacaggatgctctcattctattttacgaccattggattctattttagtagcatgctcaccgttcttactgtatatgcattcctgtatggacggatgtacatggttatgagcggattggagaaagagattttgagactcgcaagcccgaatcagcttgaggctcttgagcaggctctggctacacagtcaatatttcagcttggtttcttgatggtgttaccgatggtaatggagattggcttggaacacggttttcgctctgctattgtcgattttttcataatgcagctgcagctagcctcggtattctttacattccagcttgggacaaagtcacattattacgggagaacaattttacatggtggttccaaatatagaccgacgggccgtgggtttgttgttttccatgccaagtttgcggagaactacaggttgtattcgagaagtcactttgtgaagggactagagctgcttttattgctagttgtttatcaaatctatgggcattcataccggagttcaaacctttatctgtatatcacagtctcgatgtggtttatggttggttcttggttgtttgcaccatttatattcaatccttcggggtttgagtggcaaaagacagttgacgattggactgattggaaacgatggcttggagatcggggtggtataggcatcccggttgaaaaaagctgggaatcgtggtggaacgtagagcaagaacacctcaaacatacaagtattagagggaggattctggaaatcacacttgctctccgctttttcatttatcagtacggaattgtttaccagctcaatatctctcagcgcagcaagagctttttggtttatggactctcttgggtggtcttgctcacatcattacttgttctaaagatggtatctatgggcagacgaagatttggaacagattttcagctaatgttcaggattcttaaagcacttctcttcctcggctttttgtcagtcatgacaatattatttgtggtgttcaaactcacactcaccgatctctctgcttcagttcttgcttttcttccaaccgggtgggcgattcttctgattgggcaagtactgaggtcaccgatcaaagctttaggggtttgggactcggtgaaagagctaggaagagcgtatgagaatatcatgggacttgtaatctttgcaccaatcgctgttctgtcttggtttcccattgtctccgagtttcaagctcgtctgcttttcaatcaagcttttagcagaggccttcaaatctctatgattctcgctggtcggaaagacaaagcaacttcttcgcacaagtaa

SEQ ID NO: 11 - DNA, 798 bp, Arabidopsis thaliana
agaaccccaaagtaaagtacaccaattgttgagagaagaagagttctttttttttcaaaggtatttaaggagaagagtcgcagtcgcaaaaagacgaatcgtaattgttgaagagagcaaatatggcttgggatttgtttttatggatagtctccttcttcgttagcttggctctcgtcgcttccgtcttctaccaggttatctgcttaacggatttagaagctgattacttgaacccttttgaaacaagtacccgtatcaaccgattagtaatacctgagtttatcctccaagggtcactctgccttctcttcctcctcacatggcattgggtcttctttctggtcgccgtccctgtaacagtctatcacgcaatgttatacaaagagcgacgttatctcatcgatgtcactgaagtgttccgtggtatcagctttgaaaagaagctccggtataccaagctcgggttctacgtctttctcttcatcatggttgtctttaggctcactctctctgcggtctatagcttcacggaagatgatgatctacttcatttgttttgatttatgcgcttgcgctctgcgttatcaaccactctctctttattttctgagtgtgttttagaaaattgtgacaggtttttattacgtccctgcttagaattagccattcagggattcatcatgtagctttatataacgtatgattaccgaaaactcatcacaaatcgtttgacatggagggtttcatcagttttgttttgcgcaatataatgttcagtctcatcattgaagtcat

SEQ ID NO: 12 - DNA, 689 bp, Arabidopsis thaliana
accgaagggaaaaaagtaatatcacaaatcaaaaactaaacattgagaatgaactcagtgtgtatctccagctgcatcaacgatgcacacgaccctcgcgtgccggttcgtcctgtacgtgcctcctacgtgaatctctataagtggccggagtccgacgccgagttcgtcaggtccgtacgtcgtggaggcggcctaccggcggcccgtgtagttgatagcatatcttgtcgacagatgtatctccgtagctacactttctctcgggaagacgacgagagcaaatcggagaaggtgtcgtctgggacgcagacgtcgtgtctagggagagttaagggaacagcgtcgtctcgacgtaagagtaaggaggaaaatggcatcatcatcgttgagagtacaaagccgcgtcgtcgtggtgagaagaggagagttagtaggaagaacaaacaagaacaagcttgttctgttattttaaggatttttcgaaggttattatcttgtgctgctaccgttgatgttgttgatccaaactaaatgacttactttttcttaaaattataattagtatttggaatttttgtttctttgttttaatagtgatccttaaatgcatggtcttttaattatatttacttttttgtttgttttgttttgtatttatacttgtaatatatagaatttttcatggt

SEQ ID NO: 13 - DNA, 723 bp, Arabidopsis thaliana
taaggtctctcagaaacattctcagagaagcagagagagacattcacagtaaccatgtccgtctctctgttcactgccttcaccgttctctcactctgtttacacacttcaacatctgagtttcagctgtccaccatatcagctgcaccttcgttcttgcctgaagctccatcgagtttctcagcttctaccccggccatgtctccagatacctctcccctgttccctactccaggttcaagcgaaatgtctccttccccgtcggaatcgtctatcatgccgacaatcccctcaagccttagtccaccaaacccagatgctgtcactcctgatcctctgctcgaagtttctccagttggatctcctcttccagcttcttcctctgtttgtttggtctcatcacaactctcatctctgcttcttgtcctactcatgttgctactagctttctgcagtttcttctagtaatcatatagaaacagcgagtaagcagcactctacacaatatcatcagcagaaaccaaatattcacaaatgtattctttcttactctctgcttcttctgaatttttttcatgtaatattaatatagcttcttctagtgttcgttcgtgtgagatttgctcataaagcactctgcagtttgggctagtgcgcagttgttgtacttggtagcagtgatagtgtgtgttttttgtgcctcaaagtcaaaattgattgatc

SEQ ID NO: 14 - DNA, 901 bp, Arabidopsis thaliana
agggaccgtcggatttatctgacttcctctccttcgattagggtttctgaattactactcctctgccaattagggtttaagcctctccagcattttctttcagctcaaacccaagaacctcatcgccgattatttcttcatccttactctatcccgcgccgattaatctctctcagtaccgtccgagatgagaaagctcaagtatcacgagaagaagcttataaagaaagtaaatttcttagaatggaaaagagaaggtaaccatcgggaaaacgagattacgtatcgataccacatgggctctcgtgatgattacaaaaagtattcaggattgtgtaggatggtgcagaaactgacgaatataatgaaacaaatggatccagcagatccttttcgtattcagatgactgatatgcttttggagaagctatataacatgggtgttataccgactaggaaaagcttgactctaactgagcggttatcagtttcatccttctgtaggcgtaggctatctactgtgctggttcacctgaagtttgcagagcaccacaaagaagctgtgacatacatagagcaaggacacgttcgtgtaggaccagaaacaattactgatccagctttcttagtaactcggaacatggaagatttcatcacttgggttgattcatccaagattaaacgaaaggttcttgagtacaatgacacattggatgattatgacatgcttgcttagctttgaggaagttaaaaaagactgatgttttgtaaaagccaaaaaaggttcactgctactactattgcagggtttgtttggatttttgaatatgcaaatgtgctactattcccttgtctttaatcttactttcgatctatttgcaagaagaaacttgaaaacaaa

SEQ ID NO: 15 - DNA, 1189 bp, Arabidopsis thaliana
atcaaacctcaacaaaaatactctctcttatttcagacttttcagacaaaaacagagagaaactttttgtgtttatgtgttttaagatctgattgataaaaaagatgcaagttatttctccttcgtctccggcgccgagattcgccggaaaagagagattttcagaagtttacggcgaactaaacgacgattttggctctaaactgaagattagttctaaagaggaagaaaacagagatgatgattcatggtggaatcagaacggaactgataaagatgatgaaggaagagaagaagatttctcattcgcaagtgtaaacgcagataattcaccgataaccgcagatgaagcattcgaagacggtcagatccgaccggtttatcctctgtttaaccggaatattttcttcgatgatccagaggaaaaaactttacgttcacctctcaagaaactcttcgttgaatccacaaccacagaagaagaagaagaagagtcagatacggtgggtccatattgttcatggacaaatcgtacggtggagcaagcatcaccagagacttgtcggaaaagtaactcaacagggttctcaaagctatggagatttagagatcttgttttgagaagtaacagtgatggaaaagatgcgtttgtgtttttaagcaacggctcttcatctacatcgtcgacgtcgtctacggcggcgagattgagtggtgtggtgaagtcgtcggagaaagggaaagagaaaacgaagacggataagaagaaggataagatgagaacgaaatcggcacatgagaaattgtatatgagaaacagagcaatgagagaagaagggaaacgaagatcgtatcttccgtataaacatgttgggttcttcactaatgttaatggtttaaccagaaatgttcatccctattgattaaaccgatctgtcgtaccaaaatctctaccgacaaatctttgccttttgtatatatctaaccttttttttggtttctgtgtattataaaaccttctttttgtaagtaaaagtgaaactttacttattaacttttcgtttgtatcatttgattagttttttttcttctttgatgtaaagtattttttgattttgaaagtagtagagaaaagattcatcgatcttttttggaatttaagtttgtcaataatatattttggtatatc

SEQ ID NO: 16 - DNA, 5369 bp, Arabidopsis thaliana
ggggctcttgttgtgttagagagagctcagatcagatgtggctttcttcttcttctccttcttcttccgcatagtgactctgagaaccagattattcaagaaaataccctttttgtttccttgttcgtttattgtggctcgtctctaacagcttcggtttaagagttctctgtttcactccccatggctcagaagccggaggaacagttgaaagagctgggatcgaagcttgacctagctcctgtttctaaagattcattgctcaaactcttaaaggaagctgctgtttgtctttctgagttggagcagtctccaccacctgcagtgctcaagtccattcagccttttcttgatgcagttattaaacctgaaattctcaaccatcaagacaaggatgtcaagcttcttgttgcaagctgcgtttctgagataactcgtattacagcacctgaagcgccttacagtgataatattatgaaggatatttttcaactaattgtgagcgcttttgctgggttgaatgatgtcagtggtccatcatttggaaggagggttctcattttagaaacggttgcaaagtacaggtcatgtgtagtgatgttggatcttgaatgtgatgatctggtgaaagaagtgtttactacatttcttgatgttgctagagatgaccatccggagattgttttctcatcaatgcaaaatataatgattgttcttttagaagaaagcgaagatgtgcaagagcaccttttactaattttactctctaaattgggccgcaatagaagtgacgttagagatgctgcaagaagacttgctatgaaagtcatagagcattgtgcgcccaaagttgaatctgacataaagcagttccttatctcttcaatgtctggagatagccgattttccagcagtcaaattgactaccatgaggttatctatgatttgtaccgctgtgctcctcaggccctatctggagttgcaccatatctcactggagagcttttggcggataaactggaaactcgtttgaaagtggttggattggttggagagttgttttccttgcctggacgtgtcatctctgaagagttcgattcaatttttttggagtttctgaaaaggctgaccgatagggtagttgaagttaggatggccatccttgaccatattaaggactgtttgctctcagatcctttgagagctgaggcttctcaaattatatctgctctctgtgaccggctcttggattatgatgagaatatccgcaaacaagttgttgctgttatttgtgatgtgtctgtgagtgcattgacgtcgattccagttgacactatgaagttagttgctgaacggcttcgtgacaaagctatactcgtaaaaacatacacaatggaaaggttgactgagttgttccgggtatattgcttacggtgtgctgatgggaaggtagacactggcgattttaattggattcctggaaaaatcttgagatgtctttatgacaaagatttcaggtcagatacaattgagtatattctatgcagttcactgtttcctagtgatttctcagtaagagataaagttaagcattggatacaaatcttttccgggtttgacaaagtggagaccaaagcttttgagaagatactggagcaaagacaaaggatacaacaagaaatgcaaagatatttgtcaatcaagcagacacaacagactgctgatgctcctgagattcagaaaaagatcctatttggattcagagttatgtcacgtgcattttctgaccccccaaagactgagcaaaactttttaattcttgatcaactgaaagatgctaatatctggaagattttgactaatctgcttgatcccaacactagcataacgcaagcatccaggattcgggatgatatgcttaaaatactctctgagaagcattctctctatgattttctcagcactctctccataaagtgttcttatctgctattcagtaaggagtatgtgaaagagatattagcggaagtatctgttagaaagtcttctaaaaatacattggggatccaaccttgcatggacttcttagggctcctggcatgtttctgtccatcattgtttgatggcgctgaagaagaactgataagtttccttaaagatgacgatgaaatgatgaaggagggtactctaaaaattctggcaaaagcaggtggaactattcgggagaatctcattgttttagcaagttctgtggaccttttactggagaggatttgtgtagaaggaaaccgcaagcaggctaagtatgctgtgcatgcgctagcatcaataacaaaggatgatggcctgaagtcgctctctgttctatacaagagacttgtggacatgctggaggacaagagatatcagccggctgttcttcagtgtcttggatgcatagcacagattgcgatgccagtctatgagactagagaaagcgaagtagttgagtttattagaagcaaaatcctaaagctcaaaagtgaaactgtggatgacaaaaaattgtcatgggatgacaaaagtgaaatttgtcaactgaagatatatgggatcaagacgttggttaagagctatttaccttttaaggatgctcaacttcgtgcgggtgttgatgatcttcttggaatactaaaaaacattctttcctttggcgaagtatccgaagatctagaatcaagttctgttgacaaggcccatttgagacttgctgctgcaaaggctgtcctccgcctttctagacattgggatgataagatacctattgagatcttccatttaactttaaaaacccctgagataccatttcctacagctaagaaaatattccttgggaaagttcaccagtatgtaaaggatcgggttttggagatgaagtatgcctgttcattcctatttgatatcactggatcaaatgttctcgaatcagaggaggataaacacaacctagctgatatcatacagcattcttatcaaacaaaagtgcggaaaatttcggctcagactgatgcaaattcagttactctctaccctcatcatatcctcccttatctggttcatgcacttgcgcatcattcttgtcctgatgtcgagaaatgcaaagacgtgaaggaatatgaaatgatatatcgccaattatacttgatcatttctatgttgctccataaagaggaagacgggaagactgaagatattgataaggaacgtgagtacgttcccaccattattcttatcttccatagtataaaacagtcagaagatgtcactgatgcaacaaagtcaaagaactcacatgcgatctgtgagcttgggctgtcaataatcaatcacttaactcagaaagagcctgatctacaaggggaaatcacacctgtatcgctgcctccgacgctgtacaaaccttctgaaaaagttgaaggagacaagtctcaggtaggtgaagaaaaattgtggctagctgatgagactgtcctgttacacttcagggctctcaagttggagagtcatgctgatgcatctgtgatcccccaaacttcagaaaatgaggttatgattgatggggaaagtgatggaaatgaaattcctctgggtaaaatagtagagcgtttgagagctcagggaaccaagactagaaagggcaaaaagaataaatctgtaccagctgaagatgagaatggtaaaaatgatgtcgatgttttgaagatggtgagggagataaatctagatcacttacaaatgctggataaattcgaatccagtaatggacacaaacattcccctagtgagagagcagagatatgtcaaagagatcagaagggtaacaaaaggaatgttggtgatgcaacatcagtagtttcagtccctaagcgccggagatcatcttctggccatagtccttacaagttctcaaacagtggtcctaaagttcaactgaaagcttctgaagatgagttgcatctagagagtgacatggacaaaaatgtctctttggactcgcacgatgaaaattctgaccaagagaaaatgttagaaagcatctctccccggaagagaaagaaaagcttatcatcaaaattaaagattacagaatctgattgggctctcaccgatgtggagaggcagagtaggtcagcaggaggtggtgatagcaaattaaagtctgcctctggatcaatgaaaaagcgaaaaaacgtgtcaggactggcgaagtgctctacaaaggaaaataaattggtaaatgatgaactgatcggttgccgaatagaagtttggtggcctatggataaacggttttatgaagggacagtgaaatcttatgattccacaaaacagagacatgtgatactttatgaggatggagatgttgaagtacttaacctaaagaaagaacagtgggagctcatagacactggtggaaagaccgcaaagaagtccagaacatcaaagggaaattcgaagaagaaaagatcttctggaagtaagcctaagaatccggatggcgtacagagggatgaagacccagttactactacgccaaaaggaaaaagaactccaaagaaaaacttaaaacagttacacccaaaagatacaccaaaaagtctttctttagaacatgagaaagtagagagcagaaacaagaaaagacgatcttctgctttgccaatagagacagaatatagtggggaggctggcgaagaaaaatcagagtctgaaggaaagtcgttgaaagaaggtgaggatgatgaggaagttgtaaacaaggaagaagatttacaggaggcaaaaacagagtcgagtggggacgctgaggggaaagaagctgaacatgacgactcagatactgaagggaaacaagaaaacaatgaaatggagagagaagctgaagagaatgctgagacttctgacaatgagactcttggagcttggaagagtaaagtgggtaagtcaatctcgaggacagcaatataggtttgccgtatgccgtaatgtagaagaaattgcggtgattgtcctcaaaaattggtggtctctggattgctgtggtgtatatgtggtaaaaatgtgagacttgtagggttagtgatacatacttgttctaaccaccatgttggaaagaataataggcagaaagaagctcctccagaagcttttgtggtcatgtattgtagcctctgtgtgtgtttatttgtaggtttgttttacgttttttctttttctgtaatatttacaacttatattcctttacccaaagtactattctcttgttgaacttaactgctttgccaaattttttttgtaaacttcttttgtttattttatcgcttgtcaaa

SEQ ID NO: 17 - DNA, 1770 bp, Arabidopsis thaliana
aaattcaattcgtttaaaaatggagagtcaaaagcaagaagataatgaatacattttccgcagtttgtatccatctgtgcccattcctgacaaacttacactgcctgaatttgtgctccaaggagttgaagaatacacagagaatgtagcgtttgtagaagcggtgaccggaaaagctgtgacgtacggtgatgtagtgagggacacaaagaggctagccaaagcgttgacatctctcggactaaggaaaggtcaagtgatggttgtggtcctaccaaacgtcgccgagtatgggattattgcccttggtattatgtctgccggtggagtcttctccggtgcaaatccgacggctcttgtttccgagatcaagaagcaagttgaagcttccggtgctagaggaatcatcactgatgctactaactatgaaaaggtgaaatcactaggtttaccggtgatagtgttaggtgaagagaagatagaaggagcagtaaactggaaagatcttctagaagcaggagacaaatgcggagataccgacaatgaagagattcttcagacagatctttgtgcacttcctttttcttcaggaacaacaggattacaaaaaggagtaatgctcacacatcgcaatctcatagccaatctttgctctactctcttcggtgtcaggtctgaaatgatcggtcagatcgtgacgcttggtttgatcccattctttcatatttacggtatcgttggcatatgttgtgctacaatgaagaataaaggcaaagttgttgctatgagtcggtacgatctaaggattttcttgaatgctttgattgctcatgaggtttcgtttgcgcctatagttccgccgattatattgaatcttgttaagaatccgatagttgatgagtttgatctttcgaagcttaaacttcagtctgtcatgactgctgctgctcctttagctcctgagcttcttactgccttcgaagccaagtttcctaatgtccaagtccaagaggcttatggattaacggagcatagttgcattacgttaactcacggagatccagagaaaggacaaggaatcgcgaaacgaaactcggttggtttcatacttccgaatctcgaggtaaagttcatagatcctgacaccggtagatcactcccgaagaacacttctggtgagctatgtgtgaggagccaatgtgtaatgcaaggttacttcatgaacaaggaagagactgacaagacaattgatgaacaaggttggcttcacacaggagacataggttacatcgatgatgatggagacatcttcatcgttgatcgtatcaaagaacttattaaatacaaaggttttcaggttgctccggccgagcttgaagctattctactcactcatccatccgttgaagacgttgccgtcgtgccgttaccggacgaggaagccggggagattccggcggcttgcgtggtgataaatccgaaagcgacagaaaaggaagaagacattctcaactttgttgcagcaaatgtggctcattacaagaaggttagagccgtccattttgtggattcaatccctaaatctctctctggtaaaatcatgaggaggcttcttagagacaagatcctcagcatcaacaagaagtagaagaaagaaaactcttacaagcttttaattaatctactttgatttaagaatgtccttgaacaataaatactctttgtggtttttattattgctccttgattaggaaattctacagttcaatt

SEQ ID NO: 18 - DNA, 1051 bp, Arabidopsis thaliana
aaactgaaatccccaaatcaaaaccctaaaccctaatctctaatttgagaaattaggttagttcacctttttgtcgattcctcttgcggagagatgcaatcgattcgtggcagtacacggttgcttcagaggcatcgtttctccatctccaacactcttcgtttcacttcttcttcttcttgtggaagctggtctgaaaatgaatccagaaaactagggtttgattcttgcccttctagcagagctgcgacatatctcattagctcgttgaaaaatgcaggcttttcctcttcagctatacctaaacaaaactttacgtatgcgtcgaggtgtttttccaccactggagattcttctgttcaaggatctcctgagtcagattgtgttgtgcctcagagaatcaagtttaagcggcttgataaaaccgctaagcatataatgcagattgtagacaaggaagcggttgaggaagtgagatctcttagagagattcctgagataaagcccggttacattgtgcagctaaaagtggaagtgcctgagaacaagagacgtgtatcaatcgtgaaaggcgtcgtcatagcaaggcgtaatgctggtctgaactcaacatttagaattagaaggcttgttgctggagtgggcgttgaatccatgttccccttgtattccccaaacctgagggagattaaggtggtggacaagaagaaagtaagaagagccaagctatattacctcagggacaaggtgaatgctcttaagaagcattaacaacctcagtaaaaaaaacaatctactcgtgtcttaaacaattttccaatgttttagttgcactctctcaaaaggagacgatttgcctcaaatttcacgtattgaatttgtgcaatggtgaatcttcttcaattctcttctctcccttgttggaaaaagcacatgggctaaagacatgttatagttttatatatggagacaagtaatccacgacgtttcttgtataataaaacagcgtgacgttcttttttttagctccataacacaacgctgtctttga

SEQ ID NO: 19 - DNA, 1623 bp, Arabidopsis thaliana
tcgtcgtcttcctcatttcgccggaagaattatccgccatgggagacgataagaaagatcagaagcagctttcttcatacttgaaagctaaaaacttttcatgtgattcacatttttcattttattggctaatgtcgaggctaatcttcttaattctcgccattctcttctctcttcaattcgttttctaccctttaaatttcatctcctcttcttctcaacctctgatcaaattctctgtttcacccgtcgtatccggatccgggtcggttcatgaaccggaccaaaccgaactcaagcacgtcgttttcggaatcgccgcctctgcgaaattctggaaacaccgtaaagactacgtgaagctctggtggaaaccaaacggtgaaatgaacggcgtcgtttggttagaccaacacattaaccaaaacgacaacgtttcgaaaacattacctccgatcagaatctcctccgacacgtctaggtttcagtacagatacccaaagggtctccgatcggcgatcagaatcacgagaatcgtctcggagacggtgaggctgttgaacggaacagagttggagaaaaacgtgaggtggattgtgatgggagacgacgacactgtgtttttcccggagaatcttgtcaaggttttgagaaagtacgatcacaatcagttttattacatcggaagctcgtcggagagtcatatacagaatctcaagttctcttacgggatggcttatggaggaggagggttcgcgattagctatccgttggctaaagcattagagaaaatgcaagatcgttgtattcagagatattcggaattgtacggctccgatgatcggattcatgcttgtatgtcggaactcggtgttcctttgactaaggaagttggcttccatcagattgatttatacgggaaacttctgggcctattatcggcccatccactggctcctctagtatcgatccaccatttagacttagtggatccagtattcccaaacatgggccgagtcaacgccatgagacgtttcatggtccccgcaaaactcgactcaccgagcctcgcgcagcaatcaatctgctacgacgcggaccaccgatggaccgtgtctgtctcgtggggatacacagtccagatcatacgtggcgtgttgtcagctagagagatggtgatccccacgcgcacgttcatcgattggtacaaacaggcagacgaaagaagctatgcttttaacacgcgtcctatcgccaaaagcgcgtgtcagcgtccgcgagtgtattacctgtccaacgcgcttcctgacttggctttgcgtagaactgctagtgaatacgtgagatggtacgacatgtgggagcctgaatgtgactgggatatgtcggatccttcggaatttgaacgggtcattgtttataagaaacccgacccggatagatggaataaacatagggctccgagaagagattgttgtagagtattgcccacgacgaagaatgggactatggtaatcgatgtaggagcttgtaaagatgatgaatttgctgaattccttgtcaaatagaattatttatcttttatagcgttttcttgttaccaatcgtattagtctagaatac

SEQ ID NO: 20 - DNA, 1836 bp, Arabidopsis thaliana
agtaaacagagcatgtgaccgaattttcgaatcgagaaaaccatcgtcttccttatttctacgtattttacggcgagcctctagtcgctcatcgtcagccccataaatttcctgaatcttctccgataacttcgtcttatatacatcgccacagaaatttcggttcctgttcgtgaattagcggtagggtttcatttgtatctccgcaacgaattttcctattgattggttcgtttggatctgagaggtattgatttcgatcgatctcaaaagggtagttgttcgtttgctcaatcgaacgagattgttattgttttctgctgtggaatagtatctggatctgtcagattaataggctagtttttacgattgagctatcggaaatgatttgatcttcatgtgtggttgatcatcgaagagtgtttcattgagactgttaatgaatattgctgtaagagaggaggaggagaatctgcttttaagcttctcgtcgtactcgtttctgggatttctcaggttctcaagtttggatttcaataagaaatctgcgtccaccgtaaaccctagatttagatgggataaggtgttctttcagataaaaggtgagaactttccgaatttaacttagttgaactgagatgggttcgtcacaaggctccacactctcggctgatgtgatgagccttgtggatacattgcctgtgcttgcaaaaacccttatcgctggaggagctgctggggcaattgctaagactgctgttgcacctttggaaaggatcaaaattctattgcagactagaacaaacgactttaagacccttggtgtgtcccagtcattaaagaaggtgttacaatttgatggtcctctcggattctataaaggaaatggggcgagtgttattcggattattccatatgccgcccttcattacatgacgtatgaagtttatcgtgactggattttggaaaaaaatcttcccttaggttctggtccaattgttgatcttgtggctggttcagctgcaggtggaacagcagttttgtgcacatatccccttgatttagctcgtactaagctagcttaccaggtttctgacacaagacagagtctccgaggtggtgcgaatggattttaccgtcaacctacttattcaggcataaaagaggtgcttgcaatggcttataaagaagggggaccacgcgggctatatcgtggcatagggccaacgctgatcgggatccttccttacgcggggcttaagttctacatatatgaggaattgaaaaggcatgttcctgaagagcatcaaaactctgttcgaatgcatctaccatgtggagctttagctggtttatttggccagaccatcacttacccattggacgttgttaggagacaaatgcaggtagagaatctgcaacctatgacgagtgaaggcaacaacaagcgttacaagaacacatttgatgggcttaacacgattgttcgaactcagggttggaaacagttgtttgctggtttaagcatcaactacattaagattgttccatcggttgcgattggattcacagtctatgagtcgatgaagtcatggatgcgaattccaccgcgcgagagatcaaagccagcatgagggtctttgttccttcactctcttatagaagacacagaagacagaagaaaacatgattgttagacagatttttttttccctacttcttttcattttcaaggccaatttgcccctaaaaatccttgatagtgataatattcttttgagaaattatgctaaaatttataaatctgtgatcaaatccaagcgaaagataaagttg

SEQ ID NO: 21 - DNA, 1316 bp, Arabidopsis thaliana
ccctctcccccaatttcctcacttctctctctctctcttcataatcttttcattgatcatcgaccaaccaaaaacaaaaaaaactcaaaaaatccaaaaaaatcagatctttgaaagcttttcttttgtaacactcgaaaaatggatccgtcctgtgcaaactcagtgaacggattctactcatttctaaacagatcaatggaagatctcgaaagagtttatctttcaaacaatttcatgtccgtacacttcttacagagagctctctgtcttctccgtacctctcactctcatctcactctcttagttcaaaaacttcaacttcccgtcggtgacaaatggctcgatgagtatatggacgaaagctccaaactttgggaagcttgtctcgtcatcaaatccgccgtctcctccgtcgaaaacttctcctccgccggaatttcgatcgcttccaccctcgaccgtcgtctctctcctcagctttctcgtcaggtgataagggcgatatcaggatgtagaagagaagcgatagggatagaggaagaaaacagagcattaatggagaacagagttcaaaggtttccgttttggtcggaacaaacgtcggcgacggcgatggagtcgtcgacgaagttacaaaacgggttcagtggttttcgcggcgtgctttacgcgacgaggaacatgagttcgcttctccttatggttttaatgaacggtctcgtctactgttttcccggagacgcggcaacgcaaacgcagacgcagataacgcaaacgcagagtcaagtcggaggtttcgccggagcaatggggaggttgcagcagagagtggcggctgaggttgggaggatggggataaggaaaggaatattgatgcacgagtatcgccggagcaaagcggcgttggaggagcttaaagcggagctggagcggcggttctgcggtggcggtggtggtgggggagagagggaggaggaggaggaggacgagagggagctgagagagagagttgagaatctgaaagggtattttggtaatttaaggaatgggacagagagtatagtggcgcaaatcgatgatttcttcgatgagattgttgaaggaaggaaaaagcttttggatttctgcagccatagatgatgaaatatcaaaagctgacattttgttttttatgtttacatgaaaaaaaaaaaaaaaagttgggttaggctttaggctctagatgaatcagttggtagggagttgttgtaattttttcttttttactttgttgttatgaaaaaaaataatttgaaatttgagaatttttgtca

SEQ ID NO: 22 - DNA, 1317 bp, Arabidopsis thaliana
ctttgaaatcatatgattgatctacacagaatccatttccgcaaatcggattcatgtttttgctttatcgtaggcttccttcatttgcacgaacaacaacaacaacccttctctgcaaatctatggagcctgcgataacagcgacttcttcttcttctttcggtggtggctcttctcgtctcgccgctttagcccagcaacttcgccaatacaagcccccaccttcttcatcgttcgatgactccgaggagatgcagacagatcaggagaccgctgggaaagtcgtttctcaggttgggtttcaggaatctattgctcctctttcgaaagaccctgataggtttaaacccaagagagccgctgtgttgatctgtctctttgaaggagatgatggtgatttgcgtgttattcttactaagagatcttccaaattgtctactcactctggagaagtttcattgccaggtggtaaagcggaggaggatgataaagatgatgggatgactgctaccagagaggctgaggaagagattggattggacccttctcttgttgatgttgttacttctcttgaaccatttctgtctaagcatcttcttagagtaattcctgtgataggcatcttgagggacaaaaataaattcaatccgataccaaatcctggggaagtggaagctgtgtttgatgcacccttggaaatgttccttaaggatgagaatcgaagatctgaagagagagagtggatgggtgaaaagtatttgatccattactttgactacagaacaggagataaggattatatgatatggggtttaactgctgggattttgatcagagctgcatctgtgacttatgaaagaccacctgcttttatcgagcagtgcccgaagtttaagtaccctaaaatgtgaatggctgaatgcagaacttggctacttgcttatatatatgcagacgcagtagctgaagctccaattcatttcctgctggggcatctcataacaggcttcatttctgagttgttcccacaggatgctcaatggtgattcagagaaaagttggcttgttatgattctaggcaaacatcaccctcaattgtgaatttggaggaatatttgtactcagtatttaccttcaaacgctcatttttcattgtatacttgttatcttctatttgtatactgaaccaatttcaaagcaaacttgtcttatgaggcttatgatttttattaatcgttgtagattcaagctgcagttacgttattatctctggactagattttttgtgtttcaatgataaattcagttaggttttct

SEQ ID NO: 23 - DNA, 1584 bp, Arabidopsis thaliana
gcgatcatcttctccggccctaataatggcttgcagagcaaaagaacttgtgtcgttaatcttgtataagatctgtaatcccaaaaggtctgattccaaaattgaggaacatgtggaagaagtagaggatttgaaagcagaggcagaactctttaggtctggttccaaaattgagaagcatgttgaagaactagaggatttgaaagcagaggcagaactctttaggttgaaagcaatctcaggaacagaggaactgaaagcagtggcagatgtcaagaggttgagaacaatcttagaaaacaatagtggaacctcagaggagtgtaagggtgagatgttgaaagaagatctttttcttccctcggatcttgtacgtctcatattgtctcgtctttctttcaaagacaacatacgctcttctactgtttgcaaggcatggggtgatattgctgcttctgttcgggttaaaagtcgtcgttgctggcttttgtaccatgatgcatttcaagacaagggcgtctcttacggattttttgacccagttgagaagaagaagacaaaggagatgaatctacccgagctatctaagtcttcaggtatcctttattccaaggatgggtggttactcatgaacgactctctttcactaattgccgacatgtactttttcaacccgtttacccgagagcgtatagacttgcctagaaacaggataatggaatcagtgcacacgaattttgctttctcttgtgctcctacgaagaaaagctgcttggtgtttggtataaataatatttcctcatctgtagcaatcaaaatcagcacttggcgtcctggtgcaactacatggctacatgaggacttccctaatctgtttccttcttacttcaggcgcttaggaaacatcttatactcagatggtctcttctatacagcttcggaaactgcgctaggggtattcgatccaactgcacgtacttggaacgtacttcctgtgcaacccatccctatggcgccccgctcaatcaggtggatgactgaatatgaaggacatatttttcttgtagatgcatcgtctctggagcccatggtgtataggcttaaccggttggagtccgtttgggagaagaaggaaacattggatggttcctcaatatttttgagcgatgggtcttgcgtgatgacctacggcctcacagggtcaatgagtaacattttgtatttctggagcagatttatcaacgagaggcgttccaccaagtctccttgtcctttcagtagaaatcacccctacaagtattccttatatagcaggagttcttgtgaagaccctgaagggtactactttgagtatctgacctggggtcagaaagttggtgtctggatcgagccgccccacagcatctctatctatgattattccattcttgatccctccgaagcagtaaatacagagtacgtatttatctgaattttcagcttgatttagtctcaagatttaatatgtattatctattgtaataaaccgcgtattacaatatttggtttacttataaactattttaaatttctatttattttatg

SEQ ID NO: 24 - DNA, 951 bp, Arabidopsis thaliana
atttattttgggtattagtagcctaaaaattatattttaatggatcaaaccatgtatttgggcctgatccgtatcaatccactgatatctttgaactcagtatcgggtaacgtaatcgacacgcagaagcaggttctctctctgatccgcgatttcactctgaaagatctcgtggagatttcgggttttgaacgattctactattcaatccctggagacacaggtgagttgtctttgaacgattttactattcaatctctggaggcaaggattagtcttcttcaggatgaagtttctactaatggcattgaagatgatgctcttaagagatcagtttataagctaaatggaagaattgatcaaggagaaaagttccataaaactatagatttgagtgtgggcagtgatgagactactggcataactgcaaataacaaagcttttgtggatggttctggagctgattcagaagctatcaagggaatgctatctgattcactcagcctattaaggtacactgtttctcgctggtgaaattgtagcgatgcttagattcacgacgaacaaacgaacctctccgccttttggacttgaaagtgccaaaagcgtcctactcaaagaagatggccacaaggtcgtcgggttccatggcaaagcgggtgcagacataattcaccaagttggagtccatgtcaagcccattttcaagtgaagtttttaatattttctcaaagtctcagtctaataaaaatgagctaaaaaaaagctctgttctagaaattgttatttacgtgtgtaaatggtaaataaggtctttcacgcactttgcctatgtgttacttgtgtgttgttggtgttcgtgtttcaatgtctctttatggtgtactggagtttgtaacagtactgtttaaggtgtacatataaaattttggttacgttgtgttataactc

SEQ ID NO: 25 - DNA, 4317 bp, Arabidopsis thaliana
tgctgaggatttagctgcatttattactctttttttgtcaattcaatttctcttttctttgaagctcttctcttgcaacaacaatggcatctagaaccaaaactggtttgatggagactcctcgtagtaaaccatcaccaccacctcctagactgagtaaactctctgcttctaaatccgatagcaattcggcttccccggtgccaaatactcgtctttcgcttgaccgttctcctccaaccaaagtgcattcgcggttggtaaaaggaacggagctgcagacacaactgaatcaaattcaggaggatttaaagaaagctgatgagcaaatagaattgctcaagaaagataaagctaaagctatagatgatcttaaagaatccgaaaaacttgttgaagaagccaatgagaaacttaaagaagcattggcagcacagaaacgagctgaggagagtttcgaggttgagaaattccgagctgttgaactggaacaggctggacttgaagctgttcagaaaaaggacgtaacttcaaagaacgagctagagtctattagaagtcagcatgcgttggatatctcagctctcctctccaccacagaagaactccagagggtaaaacatgaattgtctatgaccgctgatgctaaaaacaaggcgcttagccatgctgaggaagcgacgaagattgctgaaattcatgctgagaaagctgagattcttgcttctgaattagggcggttaaaggcattgctcggttcaaaggaagaaaaggaagctattgaaggtaatgagatagtgtctaaactgaagtctgagattgaattgttgagaggggagcttgaaaaagttagtatccttgagagtagtctgaaagagcaagaaggattagttgaacagcttaaagttgatcttgaagctgctaaaatggctgaatcttgcactaatagctcagtagaagaatggaagaacaaggttcatgaacttgaaaaagaagttgaagaatcaaatagatcgaagtcatctgcttcggagtctatggaatcagttatgaaacagcttgctgaattaaatcatgtgctgcatgagacaaagtcagataatgctgcacaaaaggaaaagattgagttgctagagaaaacaatcgaagcacagagaacggatcttgaggaatatggacgccaggtttgcattgcaaaagaagaagcttctaagctggaaaatcttgttgaatcaataaaatctgagcttgaaatctcccaagaggaaaaaactagggccttggacaatgaaaaggctgcaacatcaaatattcagaatctattggatcaaaggacagaactttcgatagagttggaacgatgtaaggtggaagaagagaagagcaagaaagatatggagagcttgacgttggctttgcaggaagcttctactgaatcaagtgaagcgaaggcgacgttgttggtatgtcaagaggagctcaagaactgtgaatcccaggttgacagtttgaagttggcttcaaaggagacaaacgaaaagtatgagaaaatgcttgaggatgctagaaatgaaatagatagtctaaaaagtactgtagatagtatccagaacgagtttgagaactctaaggctgggtgggaacagaaagaacttcatctgatgggttgtgtgaagaaatcagaagaagaaaattcgtcttcgcaggaagaagtaagcaggcttgtgaatttactcaaagaaagcgaagaagatgcatgtgcgagaaaggaagaagaagccagtcttaaaaataatctcaaagtagctgagggggaggtaaagtatctgcaggaaacacttggagaagcaaaagctgaaagcatgaaactgaaagagagcttgttggacaaagaagaagacctaaagaatgtcacggcagaaatcagcagcctcagagaatgggaaggttctgtacttgagaaaatcgaggagttgtcaaaggtaaaggaaagcttggttgataaagaaaccaagctgcagagcattactcaagaagctgaggagctgaaaggaagggaggctgctcatatgaagcagattgaggagttgtcaacggcgaatgcaagcttggttgatgaagcaaccaaattacagagcattgttcaagaaagtgaagatctcaaagaaaaggaagctggttatcttaagaagattgaggagttatcagtagcaaatgagagtctggctgataacgtaacggatctgcaaagcattgttcaagaaagtaaggatctcaaagaaagggaggttgcgtatcttaagaagatcgaggagttgtcagtggcaaatgagagcttggttgataaagagaccaaactgcagcacattgatcaagaggctgaggagctcagaggaagggaggcttctcatttgaagaagattgaagagttgtcaaaggaaaatgagaacttggttgataatgtagccaatatgcaaaacattgctgaagaaagtaaggatctcagagaaagggaggttgcttatcttaagaagattgacgaattgtcaacggcaaatgggaccttggctgataacgtaaccaatctgcagaacatatctgaagaaaataaggagctcagagaaagagagactacattacttaagaaggcagaggagttgtcagaattgaatgaaagcttagtcgataaagcgagcaaattgcaaacagttgttcaggaaaatgaggaattgagagaaagagagactgcttatcttaaaaagattgaggagttgtcaaagttgcatgaaatcttatctgatcaagaaaccaaactccagatttctaatcatgaaaaagaggagctcaaagaaagggagactgcttatcttaagaagattgaggagttgtcaaaggtgcaagaggatcttcttaacaaagaaaatgagctgcatggtatggtcgtggagattgaggaccttagatccaaggactctctagcccaaaagaagatagaagagttatcaaattttaatgcaagtttgctcattaaagagaatgagttacaggctgttgtctgcgaaaatgaggaactgaagtccaagcaggtttcaacactaaagacgatagacgagctgtcagatctgaaacaaagtttgattcacaaagaaaaggagctgcaggctgccattgttgaaaatgagaagctcaaggctgaagcagccttgtccctccagaggattgaagagttgacaaatcttaaacagactttgattgataagcagaacgaactccagggtgtctttcatgaaaacgaggagcttaaggccaaggaggcttcgtctttgaaaaagattgatgagttgttacatcttgagcaaagttggcttgaaaaggagagtgagtttcaaagagttactcaagaaaacctagagctaaaaacgcaggatgctttagcagcaaagaaaatagaggagttgtcgaagctgaaagagagtttacttgaaaaagaaaccgagctaaaatgcagggaagctgctgcccttgagaaaatggaagaaccatcaaagcatgggaacagtgagctaaacagcatcggaaaagattatgacttggttcagttttctgaagtaaacggtgctagtaatggtgacgaaaagacaaagactgatcattatcaacagagaagcagagaacatatgatacaagaaagtccaatggaagcaattgataaacatttgatgggtgaaagagcagcaattcataaggtagcgcacagagttgaaggagaaagaaatgtagagaaagagtctgaattcaagatgtgggatagctacaagatagaaaaaagcgaagtatctccagagagagagaccgagctcgactctgtggaagaggaagttgattcgaaagcagaaagtagtgagaacatggatcagtacagcaatggcttttctttaacagaccacactgaagattccggaaatctgctcttaaaggaacaacatatgaagaagaagaaacctttgctccggaaattcggaaacctgcttaaaaagaagagtacaagcagcagcagtcaaaagtagaggaagattatctctttgcacctgggcttttcttggttttcttgaaatttcttacgagtatagctctatatatttgatctatgctttctggttaccaagatttagattgtctatgacattagacactgccctttgatcttgttcccttattgtttatttctctgtttcatgaagttgtttttagcaaagattgaacatttcattcattatctgcatatgattctgtatagaagctgagttgcttattaag

SEQ ID NO: 26 - DNA, 2007 bp, Arabidopsis thaliana
acccgagaaaatagcagttttcccgagaaaataaaccagaggtccctaaagctaaagctaaaactaaaagctaaagtagtgtggattttctagatgccaagtttcgttttttgagccttttaagctcttttctggatttcgtttttctcgtttcgctctattcttcgccgagcaagtaatcattgccgacaacccccagaaaaatcgtagatttcttcaatcggcgatttaaaaaatttgaactttttctttaaaagctttgagctcttttttcttcggattattttcaaaatgggtctgtgttattcagtagataggactactgggaaggaacctggagaagcaagctccaccgccactacggcggagactgtggaggagagatcaggctccggaagatggcggcggccgagagatttaaagggtggcggcgatatcgaagggattccacaggttttgggtcgtttggtttcgaatggttcaagtaagattgcatgtctttacacacagcaaggcaagaaagggactaaccaagacgccatgctcgtctttgagaacttttgttcgagagacgatacagtgttttgtggtgtattcgatggacatggaccatttggtcatatggttgccaagaaagtccgagatacattgcccttcacactcttaacccagttgaaaatgacctcagagtcagatcaaagcagcttagttggtgccaatggttttcagatcaaatgtacagaggaagaagaagtgcagacaactgagtctgaacaagtgcagaaaactgagtctgttactactatggatgagcaatggtgtgagttaaatccaaatgtgaacaacgatgaacttccggagatgtatctgcctcttaaacatgcgatgctcaagtcttgtcagcagatagataaagagctgaaaatgcatccaactattgattgcttctgcagcggaacaacttcagtcactttgatcaagcagggtgaggatttggtggttggaaatattggtgactcgagagccgttcttgccacaagagacgaagacaatgctttgctcgctgtacaattaactatagacttaaaaccggatttgccaggtgaatcagcgagaatccagaaatgtaaaggaagagtctttgcattgcaagacgagcctgaggtagctcgtgtatggttaccaaacagtgattcacctggtttagcaatggctcgagcttttggagacttttgtctcaaagattacggattaatctctgttccagatatcaactatcgccgcctaacggaacgagaccaattcattattcttgctagcgacggggtatgggatgtgttgtcgaacaaagaagctgttgatatcgttgcctcagctcctagtagaagcacagcggctcgagctctagtggacacagcggtacgatcatggagaatcaagtacccaacttccaagaacgatgactgtacagtagtctgtctctttctacaagattcatcagtagccatggaagtctcaaccaatgtaaagaaggattcacccaaagaagagtctatagagagtgtcactaacagcacaagcaaggaggaggatgagattgtccccgttaaagacgagaaaatccctgagagttgcgggattgagtcgaaaatgatgacaatgacacttgcggaatgtatctcggttgcacaagatgatgaagagtggtctgctttggaaggattgacgagggttaacagtctcttgagcattccaaggtttttatctggtgagctcagatcaactagttggagaaaatggttgtgacttttttttgacttaagtgattctaagttaatgccgacaaaaacacttcatatcacgatgttccaactttttttcttcttctcttggaagtgatttgcagatatataatctttcttgtttaaattagtctttcagacatgtgagagattggtcatgttagctgtagataaagatcatagtgaattggatcttttcttggat

SEQ ID NO: 27 - DNA, 2411 bp, Arabidopsis thaliana
actctcttctctgttgctctacctgttcttttctctctgttcattctcttttctttagcttaattcagcaaaaaatttatctttgtttctctcttttgtttctttcctctgcaaagtaaagttatgagagcttaataatgtttgtctcatcttcaagcttcagatctgattccttgtttctacaagtaattgtctctttctttttcgattaaccaccatttctgtgaagaaaacctttttgcttgcttcaagattcgagtgaggaaaattttagctgaaaatgctggaaattggaagtcccaatgctctgtttttccgtacgaatactacttgtaataatcttctccgtgagcttcagaaaatatgggttgaaattggtgagactgagactgagaaagatagaatgcttatggaattagagagagaatgtcttcaaatctatcaaagaaaagttgatgaggctgcaaattctaaggcaaagcttcatcagtctgttgcatcaatagaagctgaagttgcttctttaatggctgcccttggtgtgttaaacatcaactcaccgattaaactggataaaggttcaaaatcattgaaagaaaagcttgcagctgtgacacctctagttgaggaattgagaattcaaaaagaggagagaatgaagcagttttccgatataaaggcgcaaattgagaagattagtggggaaatctcaggatacagtgaccatctcaacaaggccatgaacatttcattgactcttgaagaacaagacttgactttgaggaaccttaacgagtatcaaacacatctccgcacacttcaaaaggaaaagtctgatcgtctcaacaaagtgttgggttatgtcaacgaagtccacgcactatgcggtgttcttggagttgactttagtcaaacagttagtgcagttcatccaagcttgcatagaacagaccaagagcaatctacaaacattagtgatagcacattagagggtcttgagcacatgattcaaaagcttaaaactgaaagaaaatcccgatttcaaaagctaaaggatgtagtggcttcactcttcgagctatggaatctaatggacacaccacaggaagacagaactaaatttgggaaagttacttatgttgtaagatcatctgaagctaatatcactgagccgggaatcctttcgaccgaaacaattgaacaggtatctacggaagtggacagtctcagtaaactgaaagcaagcagaatgaaggagcttgtaatgaaacgaagatccgagttagaggatctttgcagactaactcacattcaacctgacacaagcacttccgctgagaaatcaacggcattaatagattctggattagtggacccttcagagcttcttgcaaatattgaaatgcaaataaacaaaattaaagacgaagcacagagtcgaaaagatatcatggacagaattgaccgttggctctctgcatgtgaagaagaaaattggctggaagagtataatctggatgagaaccggtatagtgctggaagagggggacatgtaaacctcaagcgtgcagagcgagctcgggttacaatcaataagatccccggaatggttgacactcttatcaagaaaacacttgtgtgggaagaagacatgcagaagtcatttctatacgacggtgttcgattggttaacatactagaagactataaactgacaaggaaacaacaggaagaggaaaagaaaagatacagggatcaaaagaagaggcaggatctcctactaacccaaagggaatccatttacggatcaaaaccgagtccaagaagaagcagcagcttcagaaagcccaatggtttcaacattagcaatgggaatggttcagtgcctcccacgcctcgtagaggctcggtagggacaacaactcctgacgttcttctaaccccaagatcttactctggtcatcatcgccaaaacgggtatttcaaagaagttagaagactctctactactcccttaaactatgtggccatgcaaaaggaagatactgtttctactacctacacatcgatttatagctctgagccagactcgcctctccaaggctgacttgactctcttttccaccggatttgtggagtaatgttaatggtaaaaaaagaaggaagtgaagaagaaggaaggagacttgtgaatacagaaggtgactgacttttaggagatatggtgagataagagtaaaaaaaataaatgtgaaatttgttattctttagaggttacaagttttctattttgaagtgaagaatactattgttttgtgtaatgccagtgtgaaagtgtgtgaatggtcattgttgtgcgtacgtatttgtgtataatatacgtatttgctatatttttgtgctttaaatta

SEQ ID NO: 28 - DNA, 3288 bp, Arabidopsis thaliana
gaaggtgaagtgatggattctgatgctagtgccaaggagaatacacaagatctttctgactacaagggaatgatagaaactggtggtgaaggcagtgttagagatgagctacaagaaccaggtttgatggtgaagcagagagaagttaaaggagttgaagcaagttatgcagttaaatgtgctaatactacagtgaagagaaagatggatcaacataaagaggcaatgttgggaaagaaacgaaataggcagactaggtttcttaatttggaagatgttaagcaagcaggtactgttaatacatctacacctaggagacagaactttgcacaggctgtccctacacgctccagtgcagttaatccacctgctgagcatggaggagaaagccaaagccaaagccatcaaaatctaaaatcagttgattttccttctactggcggtatacattcagaatctgctgaacagaagaccgaaagtaatggggaatcatattcaggtttacttggtaaacctaggaggctcaacagggatgaagaaccttctgctgaagggatgggaacatctgtatcaaggcaggcttcttggaagcagccggctaatatacggcagcccaagagcggtcattcatctagtagaaaagtatcttacagccaaagatctttcaagaagccagccacaagtagtacccaatatcaggatacatctgtggaacgtcttattcgagaggtgaccaacgaaaagttctggcgtcatcctgaggataccgaactccgaagtgtacctgagcggtttgaatctatggaggaatatgtcagagtttttgaacccttactttttgaggaatgccgggcacaactttacagtacatgggttgaactggctgaggctaatacatatgtgaaagttcgaataaaatccatcgaaagaagagagagaggatggtatgatgtaatacttaactccttaaatggctgtaaatgggctttcaaggagggagatgttgcagttctttcaactccactgcctgaatcagaccatgaggatgctggacgtgtcgctggtacagttaggagacatataccagttgatacccgtgaccctcgtggagctactctacatttctatgttggaaattctggtggcactggcagcaagattgatgatagtcatattttacggaagcttaaacctcaggatatctggcatctaacagtgcttggttcacttgcaaccacacagagggaatatgttgcacttcatgcgttttctcgacttaacccacagatgcaaaatgccattctcaaccccagtccggagcagtttcctagttacgaggagcaaacccctgcaacgcctgattgtttcactactagctttgttgaccatttacatagaagctttaatgctccgcagctggctgcaatccactgggcggccatgcatactgcagctggtactagtagtggggtgaagaagcaagaaccatggccattcactcttgttcagggtccgccaggaacaggcaagacacacactgtttggggaatgttgaatgttatccatttggttcagtatcaacaatattacacttcgttgctgaagaaattagcacctgaaacctataatcaagctaatgagtgcagcagttcagataatattttgtcaggctctattgatgaagtcctacaaaacatggaccacaatctcttccgcaccctgcccaaactctgtgctaaaccaaggatgcttgtttgtgctccttcgaatgctgcaactgatgaacttctttcacgtgtcctcgaccgtggttttattgatggggagatgagggtatatcgtcccgatgttgctcgagtcggtgttgattctcaatcgcgagctgctcaagcagtttctgtggagcgaagaagtgatcagctattagctatatcccgcgacgagattctacgacacatgcgtaacctcagactacaagaaacacagatttctcaaaatatagctggacttaaaagggaacttaatgctgcagcttttgctacacgttctcagggatctgttggagttgatcctgaagtccttatttcaagagaccagaaaagagatgcattgttacagcaccttgctgcggtggttgaagccagagataaagtacttgttgaaatatctcgccttcttattgtggagggaaagtttcgtgctggtaacaattttaatcttgaggaagcacgagcgagtcttgaggcaagttttgcaaatgaggctgaaattgtttttaccactgtatcaagcagtggtcgtaaactgttttctcgtcttacccatggcttcgatatggttgtcattgacgaggctgcccaagctagtgaggttggagttcttcctccccttgctcttggtgctgcgcgatgtgtacttgtcggtgatcctcagcagcttcctgcgacagtgattagcaaggctgctggaactcttttatatagtagaagtctctttgaaaggtttcagctagcaggctgtccgactttgttattgactgttcaatacagaatgcatcctcaaattcgagattttccttcaaggtacttctaccaaggacgcctcaaagacagtgaaagtatatccagcgctcctgatgagatttactataaagatcctgttcttaggccttaccttttcttcaatatcagccatgggcgggagtctcatagaggtggatctgtatcttacgagaatgttgatgaagctcgattctgtgttggggtgtacatgcatcttcagaaaactctgaagtcgttgggtgcgagtaaagtctctgtgggagtaataaccccgtacaaactgcagctgaaatgccttaagcacgagtttggcaatgctttgggccaagatgaactgaaagagatttatattaatacagtagacgcgtttcagggtcaagaacgtgatgttataatcatgtcatgtgtgcgtgcttcgggtcatggggttggctttgtttcagatatccggcggatgaatgttgctcttacccgtgcgagaagagctctgtgggtgatgggaaatgcatctgctctgatgaagtctgaggattgggcagcgttgatctctgacgcgagaggcagaaactgttttatggaaatggactctcttcccctggatttcccaatccctaaagtatctagttataatcccatggcacctaataatgggttaataacatcgaagctgtacccttcagacgcaccgatcataggcctgcacaccaaattacgttgaagctgttag

SEQ ID NO: 29 - DNA, 2128 bp, Arabidopsis thaliana
gggtttttgtttcttcagtctgtcgacgcttgctctctctctatttatcgaattccccgacggtgaacatcaccagacaaggaggaggagactaggaagatcgattttatcaatctcaattgaacaagatgtcgactctgttagctacatgtaaccaaaattgaaaccaaaactaagtttcttcttttgtagccttcttcatcattcaaaatatggcgaatagtaagtacgagtacgtgaagtcattcgaagtagaagacgaagttatgtttcccaatctgataattatccgtatcgatggccgtgatttttccagattttctcaagttcacaagtttgaaaagcctaatgatgagacatctctaaatttgatgaattcatgtgcatcttcggttttagtagagtatcctgatatagtctttgcatatggatatagtgacgagtacagctttgtattcaagaaagcatcaagattctaccagagacgagccagtaagattctgtctttggtagcctcattttttgctgcggtctatgtaacgaaatggaaagagttctttcctcatacaaaattagaatatgctccttcatttgcttcaaaagttgtaagttgtgcatcggtagaggttcttcaagcttaccttgcgtggagacaacatgactgccacatcagtaatcagtatgacacatgtctttggatgttagtaaaaagtggaaagaccttaagtgaaactcaggagattttgaaggatacacagaaacaacagagaaatgagcttctttttcaacaatttggtattaattataaaatgcttcctgtattatttcgtcaaggatcatgcctttttaagacaaagttggaagaaactgtaaagcatgatgagaatggaaagcctgtaaaacgattgaggagaagagaaactttagtgcattcagaaaatgttgctggaagaagcttttggaatgagcactcctctcttcataaagatcttggacattttgcaaaagacattggcaaaattgaaccagattatgttaagtcgtttcagtttgagagtagattattacctttaacttgggttgtggttaggattgatggctgccattttcacagattttctgaagttcatgaatttgagaagccaaatgatgagcaagctctgaaacttatgaattcatgtgcagtggctgttcttgaggagtttcaggatattgcctttgcctacggcgttagtgatgagttcagctttgttcttaagaataaatctgagctttacaaaagacagtccagtaagataatatctgcagtagtatccttcttcacatcgacttacatgatgagatggggagattttttccctcacaaaaaattgaagtaccctccatcattcgatggacgagctgtttgctatccaacatcagatattctcctggattatctagcttggagacaagtcgactgccatatcaacaatcagtataatacatgtttctggatgcttgttaagtctggaaaaagcaaaattcaagcccaggattacttaaagggtacccagacacgagaaaaaaacgagttacttagccagcaatttggaattgagtacaattcattacctgtaatcttccgcatgggttcttccgttttccgcctaaagacgcaggaaggtgttacagaggagaatggagaagtttcaggaaagcaagtggaagcagaagtgggcgtagactattcaaacattatcgaccaatgtttctggcaacaacatcctcacattcttagcttctcctaagacaggtattcattgctaccaaaaaaaaattccaaaccgaaaaccgaatgagattcagctcttattttgataaaccgaagctaaagtacaaaacaatcgaaccgaatggtttacttttttctttcactattttttgtttttttccattattttaaattaacctttttcaatttggtagttaattttttccttcaatgagagatttgggttgttaattttcctttgactggtaggataagcaatattagtgcttttcttttttttggtaaagtaagattcgtaaaatgtattgactaaaatgataaaagaggaagaaaatctcatccaaattttttgac

SEQ ID NO: 30 - DNA, 3629 bp, Arabidopsis thaliana
atcttccttcctctccagtggctgcaaaatcctaaatctcaccgaaaaggattttgtattgttacatcctcttcttcttcctccagatccatgtatgaaacctcccctgaaccctaatttagctatcgaatttgagattcgatccgatgtttacttccaaatcttcgtttcgtctctgataatataactccatcgtaatagaactgatttcaagacggttcgtttcgttttcctctatcccagattcggaaagctaccttgttttgaactccatagttttcccgaatctattcatcacttgctactatcagtttgcttcttctgttctgtgtagatttccttggagggggtttgttttgacgcagtttcgttgcaaatgaaggaagatttagtgcccgagtcgaacagttcggtttggcaatctccggttaagcggttggctgtagacggcgagtgtggtgaggctggtgataggagtaggactagctgtaagagaattaaaacgactcaagtcaatggttttattgtttacactagaactaggaagactaaattcaccaagcttcatgaacaagaagatgaaaatgctggattgtcgaatcatctcgaggagtcgaaaccaacgagtggtgttacaagtggcttcggtggtgatatgtgtcgcagcagctcggtaggtgaaactaacgttagtgggagctcttgtgttaagaatacacttgttgagagctcctccgggaaagtcgttgtgatagagcggttagttactggcggcttagctgaaagtccggcagttgagactgacagtagctcattagtggatgttgtaattgacgacatcaattttgtggaattgttacatgaagcgattcctgttgaaattctgtctgaaggaagcctggattttgaggtgaaaagactaggaactaaagttagaaccatgggaaaatcctatagcgtctcggagaagaaaaagcatggatcttttaagcgtacagcacagatctataaatctattgtgagaatgaagaaggtaaataatttggtccctgagaatgtagaggttcttgcggaaccagactttggccgtgagggattagatgaacagagtcattctgtcagtcttgcggacaagtccattttaatccgcagcaggccagaaacagtgagggatctttttgagaccggtttactcgatggtttgtcggtggtttacatgggtactgttaagtctcaagcctttcctctccgtggcatcattagagatggtggaattttgtgctcatgttcctcatgtgattgggctaacgttatttcaacttccaaatttgagattcatgcttgtaaacaataccgaagagcatcacaatacatttgctttgagaatggtaagagcctgctagatgttctaaatataagtaggaacactcctctacatgctctcgaagcaacaattctggatgctgttgattatgcatctaaagaaaaacgttttacctgtaaaagatgcaaaggtcccttccctttctcctctcttggccatagagggtttctgtgtaagtcatgctcggaggtagaaacttctcaggccagccttgctgcgacaaggacctcaactagtgctcctgcgtgcataacatctccggttaagagtagattgaagataacaagaaagccatcagaatccacgtcaatatcaccagtatttatgtcatcacttggaaatagcactcgaaagataacaagaaaggctttacgtcaagctttggttgggaaggcttatctcagtgcttctacaaatgtatcttcacaaaagaagtgccgatcaaaatttaagaagatgttgacccaacattctgtgacccccaaggctttgaaaagtgtgtccctttccgtttcttcgaaaaagaggagttatagattagcaagaaaggatcaaggattgcacaagttagtgtttgatagagggggattaccagagggaactgaactaggctactatgctcgtggacagaaattgctcggaggctacaaaatgggcgctggaatatattgttactgttgcaagtgcgaggtgagcccctctctgttcgaagctcatgcaggctgggcatctcgtagaaaaccttatttttacatatatacatctaatggtgtatctcttcacgaatgggcaactactttctcacatggtcggaaatattctgctaatgataataacgacttgtgtgttatttgtgctgatggtggaaatcttttgctctgcgatagctgcccaagagctttccacatagaatgtgtttcccttccgagtatacctcgtggtaactggcattgcaaatactgcgagaataagttcacgagcgaaattgctggagagtacaatgtcaattcttctgcagttgggcaactagaaggagttgatcctgttgatcaattagctggacgatgcattcgcgttgtcaagaacatggaagctgaaacaaatgggtgtgtattatgcagtggttctgatttttgtagatcaggatttgggccacggacaatcataatatgtgatcagtgtgaaaaggagtaccacattggatgtttgagtagtcagaatattgtggatttaaaggaattacctaaaggaaactggttttgctccatggactgtacgaggatcaactccacattacaaaagttacttcttggtggggcggagaagctttcagattcttctttgggaataatacagacgaagcaagagagaaatgatgtatattccatcagtgatcttgacatcagatggagactgatcagcggcaaagttacttctcctgaaagccgaatgttactgtctcaggcattggctatttttcatgattgcttcgatcctatagttgatccactttctgggagcaatcttattccgagaatggtttacgggaagactatgcaaggacaagactacgggggaatctgctgtgctgttttgactgttaatgcgactgttgtttctgctggactattacgagtatttggccgagaggttgcagaacttccattagttgcaacacgcatgtgcagccgagagaagggctactttcaattgctcttttcctgcattgagaagctactctcatccctgaatgttgaaagcatcgtggttccagcagctgaagaggcagagcccttatggatgaacaaatttgggttcagaaaacttgcacctgaacagctcagtaagtatataaagatatgctaccaaatggtgaggttcaaaggagcatccatgctgcagaaaccagtcgattcacaccaaatcattgacaagacaatcgaaaccggtgcatctttagaagaaaattttgatttgaaacaagccaatgagttgtatgttcatcctttgtgttgaggcaaagcaagtcatggatttagtgaaagatggattaaagggtgaagcgtttaggttttaaacaagttcttacaacatatactagtgtaaatttttgtagatgcgaagctcttttttgttatgtttttttaggttcacatttttacattgtgttctttttgggaacaaaagtttacgtttctaccaatacgtttttattggattatatcaagatggttactcgcttttc

SEQ ID NO: 31 - DNA, 4794 bp, Arabidopsis thaliana
ccgaggaagatgacgacaccaatcaccgggaaaaactctcctgttaccggaaaagaagaaggcgaactatctacctccgacgacgaagtacaaccaatgcaaacaagcacgagatctcctcttactgaacatatatcagcaaacacaaatatccaaaggcgtcaagctggaaatggtggatcttttattaagccttctgatgctacaccaacgaagctgacaaaccctggaggccggatttttgagacgaagcaagccattgctgccattcatgggaagaaatttcctgtaaggggcaacaacagcaacctcgtgataaacttctcagatgatgatagtggtagtgaatctgattgtaaaggacgtacacagacatcaaagattcaaccaaagggaaccatatctgggaatagaaacccgtctacattttcacaaacaaaattgaaaggaccaagacagattgatataagagccataacaaagaaggcattgtccactagcacctttagtcatgctgcgacgtccaaagtctccaacctttcatttgccaaggaaatgaaatccaataaatatattcattcctctgaaaggacggttagcaaagatgcacagcgtcctgaacagattgtggagtccaatagcaacaaacttcaggatttaaagcagcagattgcgcttcgggaaagtgagctgaagcttaaggctgcacagccaaagaaggatgccgttaacccaaaaatcactccagcaaggagggtcagtattatttctgatgatactagacatctagaaccaaacgaacctcccaagaaacgtttaaaagttagtggaattgacacaagtcagcctgttattgattacagagtggcagcatctgcggctgcaccaatgaatgcgccagacatccgcaaaagtctactgccaggtgtcaatgcaaattctagttgcaaacacctcggaagtaagagtgatgagattgttccacctgttattcctcagcatactgtggaaggaaatacaagctcaagtgtcttacaaaaaagcaccggcaaagtgaatcattacgaaggtggaagagaactcgaaacaatgaaaaatgttgataggagcgtgtcaagtgaacagttacttaaaatagtcaatggaaaccatcagccttgttcgaataattctggcctctacaacatcccgggaagtacaacagttcctggacatagtcaactggatatgctatccttgacgaacctagaggaatcgcttgacaaagagttggaggaagcacaagaacgaaaacgcctttttgaaattgaagaaagaaatgctcttaaggtttatagaaaggcacagagatctttgatagaggcaaatgccagatgtgcagaactttacagtaagagagaaattttatctgctcattatggatctctcatcgttcgtgactccagattgttgtggccttctatacatggtgagaatcctgaaaccgggtttcacttcttgaataatagtactggaagcattgatctggcaaccaaaacggacattgctcagcattctcagctagaaagcaaccacaaatataacagtgaatatgttggcagtcatcctccacctcattcccgtagtggacagaatttggggtacagtgatcttggtgctagtacctctgatggattgccttgcggtaacaagcaaactgcaagtagactatgctccccatcaagtgatgcaaacattttgccagatgacgagtcatttccagttgaccatgaatctaccgaggggaaccctggacatcaaaaagaaaatattgatcaaacactaggcaatcagaatgctttgcttcttgaagcatcattaagatcaaaattgtttgaccgtctaggcatgagggcagaatctagaggtggcacatgtttcaatgaagagactgtgatagatagaggggatgaaagagatttcggaagtgaaggaacccagagagataacggtagtcctttctccgaaatatatctgcataatgattctctagagccaggggccaataaactgcaaggaagtccatccgaagcaccagttgaacgacgctcaatcgaggaaaattcgctaaattatcagttatctatagatatggagtcccataggagttcaccagagaatgcccttttatcgtctgtagcgttgtccggtcctttatttcggagcacaatctatcatttgaaagtcccagggtcttcaattacatctctgggaccagaatatatacttcaaaacaagacatatagcctatatagtgataaaagacaatgtaggagcttgacggaaactatagtatatgagaaaaaaattggcttctacacctgtaatttgaaggtggacccttcttggcctctctgcatgtacgagttacgtggaaggtgcaataacgatgaatgttcttggcaacatttcaaggatttctctgatgacagtttgcatcaaagtctacatgatcctgatggtagagttgggtcaagttcacatcagaagacacataattcttccaaaggatcccagattttggactcagtgttttcaccaacttatcttgtctccttggatacgatgaaggttgactcgtggtcttatgagtccgttctggctcaaagacatggacaaatatggtgcaagcactttagtgcctgcctagcctcatcaaactcgctttacaggaatgtacctgcaaaggaaaatgaaggtcgaattgtggtcctaggaaattcgaaaacatactcatcatacttcaggattaagcatagcttaatgaatatccttaaacaaggttcagatgctgctgttgaacccatggaaatggctcttattattttctttcgggaagttgagcagtcagaaggcttgatccaggccctttctttgctttcacaaggtcttgaaggtgacccaacttctgagattctttgggctgtttatctcctgatttaccatgcatatgaaggatcagatgggaaagatatgttttcttatggggtcaaacacagtagcagatcatacgtaatttggcttatgtacatcaacagtcgaggacaacttaatgatcaattaattgcatatgataccgccctctcagcactttgcaaccatgcatctgggtccattgacaggaatcatgccagcgcttgcatattagatgttttgttgcagatgttcaaccttttgtgcatttctgggaatgtttcgaaggcaatacagagaatatccaagcttcaggctccagcagcagtttctgatgaccctgacttttcactgatgtctcacattctcacatgcttaacatattctgacaaatgtgtgttctgggtttgttgtgtgtacttagttatttacaggaagctgcctgactctattatccgacgacttgaaatggagaaggaactacttgaaatagaatggcctactgttaatttggatggtgatctgaagcaaatggcgctcagactatttgataaagggatgcgttccgtagaacatggtaccaacaatggaatacaaaagcgacctgctgggctatttgctctgaactacgccctgtttatgattgcagtagatgagttagaaagccgtagggacattttgaaggcatctgttcaactctacccaacatgcttggagctaaaattgttagcagttaggatgcaatcaaatgagttaaaggatatgttttcgtctgggtttgaagagcttctcaagcaggaagcaaaagaggcgtcatgcatacagtgtatttggaatcagtatgctgaatatgctttggaaggaggaagctacgatttggcaagagaactcatgtcccggtggtacggttcagtatgggatgttttgtcccataagtataagacagtacgaggcaatgaagaagaaggggatgataatatgctggaatcagctttatcagatctaaatgttgcatcggatcaggtggatgtgatgtttggatatcttaatctctctctgcataatctactgcagagtaactggactgaggctcgcttggccattgaccaagcactaaaagcaacagctcctgagcatttcatgcactgtcttagagagcatgctgtgtttcagctaatcaacgagttgcaagcaacgggtgaattttcaatcaacctacaaatgagattactcaactcttatttggatcgagcaagttctttacctgtaaaagagccactatcttggaaattcattagcaacagcgctgagaaaccaagagtcaggaagctagttactaaccttctggctccagtttcatctgaactctttgtggtgaatgttgttcttgaagcatggcacggaccatctcttgtacccgagaagctaagtaagcaaaaggaactggtggattttgtggaaacaatcttagggttggttccaagcaattacccgctggctttgtctgtaagtaagctgttaaggaaagaagagaaacaatcagattctggttcctcctcgggtattcatttctgggcaggtctgaatttggcgagtacaatatcttgtgccatcccagtagctccggagtatatttgggtggaggctggagaaatagtgagtgatatcaatggtttcaagactagagctgagagattcttgaagaaagcattgtctgtatatccaatgtctgtgaagttatggagatgttattggagtttatgcaaaagtatagaagagagaaggggtattgagatcgaagaagcagccagaaagaaaggaatcactcttgcttgaaactag

SEQ ID NO: 32 - DNA, 2335 bp, Arabidopsis thaliana
aatttagttaaggatgaggaagatgaagatgatgatgattcgaaaatgaaggtggtggatactgcaaatggctgctgagtgctgagacactctcgaaccccacaaaccctaaggatctcctccgaagatttccactattactggaagtgatatagatacgttgcaacaaagaagaccacacaaaaacgttattgagcagccgtgaaatcgatttaccaattgaagcttccccccatgatttgactttccctgatgctcgtttgtgggaaagggtttctaaagtgcagagcacctggagttccattcttttgtgacaaaagaaaatccttcttcactaaaactaagaggggctttcacagtttacctttgggcactggggtccgtgtttatttcaacaacaatcttaggtactcaagcaattcaatagaagttgtggagaaagctgccattaatatgggttcaaaggaagacaaggcagataatccagctttatcttcatatgatgatgccatggaagctctgtcgactcttatttctcgtcgaaaccgtggggatcgcacacctactaaaggaaatcgtgacaagcttgaacaagtcgtcacatatctcaagattttggacctggaagacaaaataaaagaactaaaagttattcatgtcgcaggaacaaaaggaaagggttcaacatgtgtcttcagtgaggcaattttacgtaattgtgggtttcgaaccggaatgtttacatctcctcacttgattgatgtgagggaaagattccgaatagatggcttggatatatctgaggaaaagtttctacagtacttctgggaatgttggaagttattgaaggagaaagctgtagatggtcttaccatgcctcctctttttcagtttctcacagtattggcatttaagatttttgtttgtgaaaaggttgatgttgctgtcattgaagttggacttgggggaaaacttgactcgacaaatgtgattcaaaaacctgttgtctgtggcattgcttctcttgggatggatcatatggacatattgggaaatacgctagctgatattgcctttcataaggctgggattttcaagcctcaaatccccgccttcacagtaccacaactctctgaagcaatggatgttcttcagaaaacagctaataatctcgaggttcctctagaagtagtagcgcctcttgaacctaaaaagttggacggagttacgcttggcttgtctggggatcatcagctagtaaatgcaggtcttgctgtttctctttcaagatgctggcttcaaagaaccgggaattggaagaagatatttccaaatgaaagcaaggaaactgagattcccgtggcattttgtcgtggtcttgcaacggcacgtcttcatgggagagctcaagttgttcatgatgtagtttcagatccgcaggactcatcagactcgatggaaactccatgcggtgatctgatcttttacttggatggtgctcacagtccagagagcatggaggcttgtggtcgatggttctcttctgcagtcagaggagacaaaagcttatccactgctgtcaatggttacatgagacatggggagtatggtacagacttaaacagagtctccaaacagattcttctgttcaactgcatggaagtgagagaccctcaagtcttacttccaaagctggtcaccacttgcgcttcctcaggcactcatttctcaagagcgctttttgtcccgagcatgtctacttacaacaaagtcatttcgggtgcatcagcgattccttcagatacacgtagaaaggatttgacttggcaattcagactacaaagactatgggagaaatcaatccaagggactgatgcggggcttgaccatacactgaaacccgatggaataaccgccttaccacctcatgatttcctgtgcggagatgcacctcaatgtggtggacctgcagggacaccggtcacttccagtgccgtaatgccttcacttccattgactataaactggctaagagactgcgtacgccgaaacccttcactgaaactagaggttctggtcacaggatcgctacatcttgttggagatgtgctcaggttgctaaagagatgattttatttttcaccaacaaatcttcaaaaagactccttaagagtaatcttacagagcttcaattgttctttacttcactgtttttttctcatagttactatttgattctttggtccattttatctaacatgagaagtgagaaccctccacttaagctgtatttttctgctaaattttaatttatatttcctctcatttctcatca

SEQ ID NO: 33 - DNA, 2146 bp, Arabidopsis thaliana
aaacctagctggtagctgctacaccagtttcgcttgtgatcaggatctatgggcaagtctagtaagaaatccgtcaccgaagttgaaacacctgcttcaatgacaaagccactcaagaaaggtaagagagatgcggaagaggatttggacatgcaagttacgaagaagcagaagaaagagttgattgatgttgttcagaaggagaaagctgagaaaacggtacctaagaaggtagagagtagcagttctgacgcttctgattctgatgaagaggagaagactaaggaaactccatctaagttgaaggatgagtcttcttctgaagaggaggatgactcttcttcagatgaggaaattgcgcctgcgaagaagcgaccagaacctattaagaaggctaaggtagagagcagctcatctgatgatgattctacttcagacgaggaaactgcccctgtgaagaagcaaccagcagtccttgagaaggctaaggtagagagcagctcatctgatgatgattcttcttcagacgaggaaactgtccctgtgaagaagcaaccagcagtccttgagaaggctaagatagagagcagctcatctgatgatgattcttcttcagacgaggaaactgtccctatgaagaagcaaacagcagtccttgagaaggctaaggcagagagcagttcatccgacgatggatcttcttcggacgaggaacccacccctgcaaagaaagaaccaatcgttgttaagaaagacagctcagatgaatcttcttcagatgaggaaacccccgttgtgaagaagaagccaacaacagttgttaaggatgccaaggcagaaagcagttcatcagaggaggaatcttcttcggacgatgaaccaacacctgccaagaagccaacagttgttaagaatgctaaaccagctgcaaaagattcatcatcctcagaggaagattctgatgaggaggaaagtgatgatgaaaaacctcctacgaagaaggctaaagtttcatcaaaaacttctaaacaagaaagctctagtgatgaatctagtgatgaatctgataaggaggagagtaaagatgagaaagtgacaccaaagaaaaaggattctgatgttgaaatggtggatgcagagcagaaatctaatgcaaagcagccgaagacacctactaatcagactcagggaggatcaaagacgctatttgctggaaatctttcctatcaaattgcgagatctgacatagagaatttcttcaaagaagctggtgaagttgtcgatgttagactttcttcatttgatgatgggagttttaagggatatgggcatattgaatttgcttctccagaagaagctcagaaggcattggaaatgaacggtaaattgttactaggccgcgatgttcgtcttgatcttgctaacgagaggggtactccacgaaacagcaatcctggtcgcaaaggagaaggaagccaaagtcgaacgatttacgttagaggattcagttcttctcttggcgaagatgaaatcaagaaagagttgagaagtcattttagcaagtgtggagaggtgacaagggttcatgttccaacagatcgtgagactggtgcttccaggggctttgcttacatagatttgacgagtggattcgatgaggcgttgcaactgagcggaagtgaaattggaggagggaacatacatgtggaagagtctagaccaagagatagtgatgagggccgttcctcaaacagagcacctgctagaggagcacctcgtggccgtcactcagatagagcacctcgtggaggacgtttctcggatagagcaccacgtggacgtcactcagatagaggagcacctcgtggccgtttcagtacgcgtggaagaggacccagcaaaccaagtgtaatggaatcatccaaagggacgaagacggtctttaatgatgaagagtagaagaaagctgtttttggttctatcttatagtagtagagcgtttttggcctagtttcttttgttttctgttgagaaaagcattaagctttatactcttcttaagattctttttgttggtttttcttaaaacttattaagagcactttactttgctgctcaaaattttggaataaatccttttgacttc

SEQ ID NO: 34 - DNA, 2826 bp, Arabidopsis thaliana
ggggaattgttttttgtagagccctaaatagaaaatctccaactgtagtgaaagtgaagaagaagaagaagatggtggagatctgaaaatatgcgatagatctgacgaatgcagatctaaaatgtcatctagaggaagggagaggatgatgatgaaggaagacggtagaggaaggaatccaccgtcgcgacatctttgggttggtaaccttcctcatgggatacttgaacgagaattagccgatcggttcttaagatttggtgaattggaaagcttagcgtttcagcctggacgaagctacgcatttgttaattttaatcacgatgaggatgcgttcgctgcgattgagtcgcttcaaggcttcccactctctggaaacccacttaggatcgagtttgctaaggcggaaaagtcatcaactggatcacgcactgatgatatatatcgccatgatgaacagcggtctgcagcaagagggtcgtcttttgtccaaagggactccagaatgcgttatgagagcccagacacatatagcaaatcaaaaatgaatgatagaaatgcagaacccagtgaggtactatatatagggtttcctgcttcgttgaaagtagatgatgcgctcttgaggaacgtcttttcttcgtttggagaaataacaaaggtcacggtattccctggtcgcagttatgcatttgttcaattccgaaatctgatggcagcttgtaaggcgaaagaaagtcttcagggaaagttatttggcaatcctcgagtgcatatttgttttgcaaagagtgaaccttcctcatctggcagtggaaggggtccgtcgggtagatcactctctccaccttacagatctgttgatcgactgggatcttcagaaggttatcttcaggatagaaactatggaagcatcagcagaattcccagtgtgagggaaccacattacatagaagatagggatttagaagattctgaaggttacatttttaacaggaaacgagactcaagtagcgatggaggtcctgcatatggaaggtcgagatctacgcatagatttcctcaggatatgcatgaatatcatggtagtcctggggaaatgggtacttcattccgtgataatcctcacagattccagacaaggagttcagagtatgaagagccatgggatctacccgaagatgactactactaccaggaaatcaagagattgaagacaagatcctcgcagcctgagaggcagctcccagggcatcagctttctggtatagagcaagaaagacgccccttttcaagggcatctgctgatttttccccaaaagatgcatttgagcggaactatgaggctggacagctaagatacaaccaaacagttgagcagccgttaaacctggctataaggaatggggacaagagtagcttacgagaaccacatgaagagttaatgggaggttatcctctgccatcagttgtccctgaaagaaaaaggtacacccctgaactgaatcgaccatcactaaaggactggaactgggaagggactattgctaagggaggcaatcccatttgtcgagcaaaatgctttcctgtgggcaaagtgatggacatgatgctgcctgagtttctagattgcacggcaagaactggtttagacatgctggctaagcattactaccaatcatctaaagcatgggtggttttctttgttcctggaagtgatgctgatatcgtgttttatgatgagtttatgcattatctggaggagaagcaacgggcagctgtttctaaattggatgacacaacaacgttgtttctggtgcctccatctgatttctccgagaaagtacttaaagttcctgggaaactaagcatctctggagttattctacgtttagaatgtggtggttctggctccggtgggcctgttcaacagcaaggtgagagaaaagatacagacttgctaacttattatggtgaaacatcatattcagaagctagtggagcgtttcctgatgtgggaaacccacgtattccgggtccaacagcttttctgcgtagtgcgggtcgtgacaatcaaagtgcatcaatggatccatacgtcgaggacaagcatgatcagttgagtcaccggtattctggatcggactggccgcctcgtgatacaaaccccagaagttcacccttcatagatcatactgttcaaaaacacagcgggtttgttcctgggaaacagcaaaatgcagatctaagtcgttatcatgatacggaaactccagtcccagcagggtttcagcctgaacagcttacacatttagcttcctcgctacccagacagcaacaacaggtacagaacactccaaatcagcctgagagatatgcaccagaaggccgagcaagtttcagccatttgcaacatgcgcagacaccaagcatacctcaattggtaactccacaaaatcaaaatgtacagatacaaagtagcaacagccaacaacaagaagaaacagaggctaatccacagaagcgtcttcaagcaacattacagctagcagctgcacttctccagcagattcaacaagctaaaccgagttaatggtggcttcctgagtatgaaatctttacattctttcttgctggttggtataaagaagaaaaggcgcaaatgcaagtgttctaatatcgagattaacatgccgtaatacatataggcaaaagcctttccagtataagatgattgtaaaatgtagaatcctcattttacgtcgttttaccttttgtatgaaaccaatactacgttacgttgaatagtaatattcatttttctca

SEQ ID NO: 35 - DNA, 1789 bp, Arabidopsis thaliana
ctgtctcctccaatcatgtcgtttcaaaatcctctaatttctcagtcctagcgctaaagctcttcctgggttcgagttgatttctcagtcatcgattgaaattttctcgggaaaaagggcctcatcgtctaccatcgacaacgagaaaccagaaaatgcaaagtcttagtcaacttggaccttcagagattttccttgtcgccagaagagaaaaacccagtacgagagcacagctttggtttacgggaagactctcttttagacaagaaacaaatgggattcgtttaaagaatagagtagagtttagtccaagacctgtacctccaaatctgatcgcagcagagaaagaagaagctaaagctgttttaactctattcttcaagaagcaaggtcttagcaacagtctctcttctcggttaatcaacaaatccgatctattcattgaccatttagtgtccaggctccattctgttcataaagctcgatacctcgtaggaagagagcttactacacttgagattcgagattctctcattccttacctcgaacaacttcatgaagaacatggtgatcttctcgctgagcttgttgtgagcttccctgatccaccagctgaacctagacttgttgcttcatctccagtttctgtcctaccacctcgtggtgacacagattctgctgcagacactcgtaaactcagagcggtgtctcgagtcagcgaacttgacacagaaggtgcattacgtcctcagaccctttaccttcttgacctcggtttaaacctcgagcagatcaaaacgatcactcgaaagttcgctgcctttccttattacagcctcgatggaaaaataaaacctgttgtggaattccttctagacctcggaattcctaaatcagatatccccacaatcctctgcaaacgcccacagatatgcggaatcagcctaaccgataacctgaaaccgacaatggcctttcttgagacacttggcattgacaagaaccaatgggcaaagatcatttcccgtttcccagccatcctcacttacagccgccagaaacttacttcaactgtcgagttcttatcacaaactggtctcacagaagaacagatagggagaatcctaacccgatgtccaaacatcatgagttacagtgtagaagacaagctccgtccaactatggagtactttagatcgctaaatgtcgatgttgcggttctcctacatcgatgtccccaaacgtttggattaagcatagagtcgaatttgaagccagtaacagagttcttcctcgaaaagggttttggtttagatgaaattggaatcatgatctctagatatggagctttgtacacattcagcttgaaagagaatgtcatgccgaaatgggattactttcagacaatggactatccaaaatccgagcttgtgaagttccctcagttttttgggtacagtttacaagagaggatcaagccgagatatgagctggttcagagaagtggagtgagactgctgttgaaccaggttttatcgctgtcgggaattgagttcgagaaagttgttaagaagaagatgatgaaacttgtgtctaataacgtaattgctgaacaaagtagtggtggtttgttgtgaatgttttagttttagagtaatcaatttgccgagttccatgtgagtcgcagaaacaaatcccagcgataccaattctgtaaactgacccattctgctgctaaatggtgttcttaaccttggcattacattggagtaaagaaaacatttatcaa

SEQ ID NO: 36 - DNA, 802 bp, Arabidopsis thaliana
gagcatgagaagcttaggggaaaacgatcaatctttgttatctctcactcttcctcttcttattttgatcttcctcacttctgtttgattcctaataatggaacacgagggcaagaacaacatgaatggtatggagatggagaaaggaaagagagagcttgggtcaagaaaaggagttgagttaactatgagagtgttggctttgatcctaacaatggcggctgcaacagtacttggtgtcgcaaagcaaacaaaggttgtgtctattaagcttattcccactttgcctcctcttgatatcactactaccgccaaagcctcttacttgtcggcatttgtgtacaacatttctgtgaacgctatagcttgcggttacacggcgatctcgatagcgattctgatgatcagcaggggaagaagaagcaagaagttgttaatggtggttttgctaggagatctagtgatggtggctttgctgttttccggcactggagccgccagcgcaattgggctaatgggtttacatgggaacaagcatgtcatgtggaagaaagtttgtggcgtttttggaaaattctgtcaccgagctgctccttcgcttcctctcactcttcttgctgcagttgtgtttatgtttcttgttgttcttgacgctattaagcttccttaattattaattgtttctgttcttgtcgttttgtgtgatgtaaaataactatcaacaatcatgtaattgtctattgcttctaatgttttatcacatcgttttctatggtgagacgatatattcaaaattcggaaa

SEQ ID NO: 37 - DNA, 1280 bp, Arabidopsis thaliana
taaaactaaacgcaaacgtgatagttgaaaacgcaaacgtgaaagttgtaaacgcaaacgtgatcctaaacgcaatgtcgaagtgaaagtcgtgatggctccgtcgtatctgaaatcgtggtaattggtgatggagaaagacgataacagtgacaaggtttgtctttcagtgaaggagaaatatacgtcagagcagcctgaggaaatggtgacaaatctgaaggcatctgtaagagaattgagtgtgaaagtgaaagaacagaatcagagaaaatgtgatgctaaggataagttgcagcagttgcgagaaagaataagcaaggaagttgttgatgtttcagtccaggagttgataccgcttcttagatcactcaaggaatttgtgaaggaggaatctgaagtcaggtctcgttgtaatgttaaacgttctgctttagaagatgcagttcatgatttggaggagagagctggtaaggggcttgatggtgagattcaagaggaagatttagatggtttgttggttgtatctttagataatctcacttcagcaaagaaggagcttggagcaacgctaagagagatagtctctctgaagcgacagattgacgatgtgccatgccaatctgaactcctccaatatgaaagaagattctcagagctgaatgtctgtattcaggagaaacttcaacaaactaggaagctctatgcaacatacaatgctcttttagaaatcaaagatttgatgcttaaggagacatcattattgaattccataggttcacagtttcaagacgtgattggtactcctgctggccgtgtgaagcttattgattcaatggaaggagtcatgaaaggaatccaacagaagattggaaaaatacaacttgggcttcaagaagagcagaggctccgtgatgcttcaaaagaaaagtatatagctgcagctgcagagcaaagaaaatgctacactgtactaagagcataccaggaggaatgtactaagaatgagaggctgagaagtcatatatctgccatgaacgaacacctctgactcgaagaagggtttgaataaggatctgatctgtgaaccggatctctgatatctcgtccccttgagatgatgcttccttgatgctctctacctgcaaatcatacatgtacatggttttatggctcctcaaacagattcaagttgataaaacccagaacagttgataactctttactgttgtatcctcattttattatgtcacaatgcaaaataagacctgattactcta

SEQ ID NO: 38 - DNA, 2415 bp, Arabidopsis thaliana
atggctgcgactctgctgtctcaatgctaccgtatctacaattccgatgcgtgcaagtgtgtttcttctgagaatcaccagacgacggggaagcgaaatgggaatcgaaatctcgaattcgactcgggaatttcgaaaccagcacggctagtacttcgagaccgatacaaggtaactaagcaggtcaatgatcctgcgctgactagggctttacgtggtttcgctgattcccgtcttatggaggatgcactccaactgttcgatgaaatgaacaaagctgatgcttttctgtggaatgtgatgattaaaggtttcactagctgtgggttgtacattgaagcagttcaattttatagcagaatggtgtttgcaggggtcaaagctgatacctttacttatcctttcgtgattaaatcggttgcgggaatttcctcattggaagaagggaagaagattcatgcgatggtgattaagcttgggtttgtttcagatgtttacgtctgtaattctcttatatctttatacatgaagcttgggtgtgcttgggatgcagagaaagtgttcgaagaaatgcctgagagagacattgtttcgtggaattccatgatttctggatatcttgcgcttggagatggctttagctcgttgatgctgtttaaagaaatgctgaaatgtgggtttaaaccggacaggttcagtaccatgagtgctcttggtgcttgttctcatgtgtatagtccaaaaatgggaaaagagatacattgccacgctgttcgaagtaggattgaaactggtgatgttatggtaatgacatcaattcttgacatgtacagtaaatatggtgaagtgagttatgcggagaggatatttaacggtatgatccagaggaacatcgtagcttggaacgttatgatagggtgttatgctagaaatggccgagtcactgatgctttcctctgctttcagaaaatgtcagagcaaaatgggttgcagccagatgttatcacatcgattaatctgcttcctgcttctgcgatcttagagggtagaacgattcacgggtatgctatgaggagaggctttcttccccatatggtattggaaactgctctgattgatatgtatggagaatgtgggcagttaaaatcagctgaggttatatttgatcgaatggctgaaaagaatgtgatctcatggaactcgattattgctgcctatgtgcagaacgggaagaactattcagccttggagctatttcaagagctctgggattcatcgcttgtacctgattccacaacaattgctagtattctaccagcttatgcagaatctctatccttgagtgaaggtagagaaatccatgcttatattgttaagtctagatactggtcaaacaccatcatcttgaattcacttgttcacatgtatgccatgtgtggtgaccttgaggatgcaagaaaatgtttcaaccacatcttgttaaaggatgttgtttcatggaacagcatcatcatggcatatgcagtacatggttttgggagaatttcggtttggttattctctgagatgattgcttctagagtaaatccaaacaagagcacctttgcttcactattagcagcatgtagcatttctggtatggttgatgaaggatgggaatatttcgagtcgatgaaaagagaatacgggatagatcctggaatagagcattatgggtgcatgctggatctcattggccgtacaggaaacttcagcgcagccaagagattccttgaagaaatgccatttgtgccaacagctaggatttggggatcgttgttaaacgcaagcagaaaccacaaggacataaccatagctgaatttgcggcagaacagatatttaagatggaacacgataacacgggatgttatgtcttgcttttgaacatgtatgcagaagctggaagatgggaagatgtaaataggattaagcttctcatggagagcaaaggcatatccagaacatcaagtcgcagtactgttgaggcgaagggcaaaagtcatgtgttcacaaatggagacagatcccacgtggcgacgaacaagatctatgaagtcttagatgtcgtctcgaggatggttggagaagaagacatttatgttcactgtgtctcgaggttgagaccagagactctagttaagagcagaagcaattcaccaagaagacattcggtaaggctcgccacgtgttttggattgatctctacggaaacgggaagaagagttacggtgaggaataacacgagaatctgcagaaaatgtcacgagttcttggaaaaagcttcgagattgacgagaagagagatcgttgtgggagattccaagatttttcatcacttctccaatggtcgctgctcgtgtggaaattactggtga

SEQ ID NO: 39 - DNA, 3487 bp, Arabidopsis thaliana
actcacttcttcttcttcttcttcttctttttcttcttctttttctttctatctctctctatcttctctctaatgtccgaggaattgaaccagtgatttggtgatctcaaagactctcaaaaatttcgtgtttgatctttgtctattttcatttgttcgcttcgggttataagttaacttcaccgttggataaaagatgttcgtgaagaagttggtcgagatagcagccaagaagcctggaggaagttcatcagaaggactgagagctaatgacgttgagccacgtatcgctctgcattacggaatcccttcaggttctcacttgtttgcttatgatccatttcagaagatcctcgccgtttccaccaaggatggtagaatcaagttgtttgggaaagatcagacccaggctttgctagtctctgaagaaacatccacaagcaggtttcttgagtttgttcagaaccaaggaatccttctcaatgtgaattccaagaaccagattgaggtttgggacttagacaagaagcttctatctcatgttcatgttttcaatggcgagatcacttctttccgggttatgcaacataccccttacttttatgttggagattcttctggtaatgtatcagtgtttaagatcgaacaagattctaatcaagttatacaactggagtacaccataccttacctagcatcaaatggctctcccattgaagcttctgaggatacttcagttgtgagcattctaccacagctaacagctgaaagcaagaggattctattggtatttagtagcgggtttatagcgttatgggacatcaaagaaagcaaaccgattctcaaaacaggagtacacggtatggtaaagcaagatacgaagaaagcgacttgtgcttgttgggtttgtccttcaggaagcagagtttcagttggctatagcaatggagatattctaatatggagcattccttccaaaggagaatgctcgccagagagttctgctatgatttgcaagcttaacctcggatacaaatccgaaaagataccaatagcttctctgaaatgggtttatgctgaagggaaggcaagccgggtttatgtcattggatcatcctcaaactcgttgcaggtggttttgttgaatgagcaaaccgaaactcggatgattaagctgggacttcatgtttctgagccttgtgctgatatggagatgatcatagctgatgttaatgaacagagcaagcataaacaagattttctgtttgttcttggaaagtctggacgtgtctatgcttacgatgattatatgattgagaagtatctgattcagtctcagtccaaatcatctccttccctcccaaaggaaactgtggttaagctgccattttcagattcaagcagcattaccgtaggaaaattcctcacaaatccttcacacttactcaatctatcagatgaggattatgctcagctggcgaaagatgctgtgccgtttcttccttttcatacagttccaaaggaaagttcccgttctgcacattttcctggtttcacaaaggttaagaatgtttacatcacaggacactgtgacggaaccattagtgtatgggacatgacctgttcttttcccattcttgtcttgtttctgaaagaacagatagatcaagatgtatcttcacgcggaaatgcggcattgacagctttacattatgacagcaactcaagacttcttgtttctggtgatcataacggaatggttcgcctttataggttcaaacctgagccatacctaacagaaaacagttttatccctttccaaggaagcttaaagaaaggaaataaccatattgttcaaagtgttaagtacatcaagcttactggttccataacctgtattcagaagagccaaaactcaaaacatctcgctattggatcagatcaaggacatgtttctctggttgacattgaggaagcaaatgtgttatacacaaaacacattgcaagtgatatatgtccagggatcatctccttgcaattcgagagttgcattgtgcaaggcttcgagaagaacgtgttagtggttgctatgagagactcgtcggtttttgctctggacagcgacacgggaaatatgattggaaccaacatgattaagcctaaaaagccattcaaggttctgtatatgcagatcctagatggaaagcaagatacttcaggaaatggatttgatacgagcagagagagcacagttgaggagatctcgataaggcagccttcggttttggtttgttcggagaaagctatatatatctactccttggctcacgttgtccagggagtgaagaaggtcctccacaagaaaaagttcagttcttcacccatttgctcagcttccacattctatggaacctctggtgttggtcttacacttgttttcacagatggaactgttgagataaggtctttgccagaactctcccagctaaaacaaacttccattagaggcttcacatattcttcaccaaaaccaaactcgttaccagagattaccatatccgcttcttgggatggagatctagtcatggtgaatggagatgatgaacttattgttagctcagttttacctcaaaaggaaacttttaggcttgtcgagtccatgaatcgagtttacaagaaagataactcggtttgtcacgaaggaatcatcacatcatcatctccaagggaaaagaagagtatgtttggttctgttttcaagactaaatcaaagcgcacaactgatacagaaccagaaagctccaaggaaacgatcgaggagctgtctaaaatcttctctacagctaatttcccctggaacaacaatgttgagaatagtagagagatcaatacaattactagggtggaagatgaagaagagttggacatagatgacattgacattgacgatcatcatcctaatcaacaacaacaagagaagcctaaagaacaagggatattgtcagggcttagtaaacagaagatggcgaataggtttagtaatttcaaaggtaagctgaaacagatggcagctaagaatgagaagagtgttgtaaccaatgacgagaagcatgaggagaaaaacggcgccacagttgatcagatcaagaagaaatacgggtttacctcgtccgatgaaatgggagctgccaaaatggctcagagcaaacttcaagacaacctgaaaaagttacagggaattagcttgaggacgacggaaatggaagatactgcaaagtctttctcctctacggcaaaggaactactaaacgctgttgagttcaataaacagagctcaaaatcttagcactctttttctctggatgtcaaaattacctactgtaaatactttcttcaaaagttatacaagtgtgtttcacgacttctttcgaacactagacaatggatagttttatcgtaacagagaagtgatcttaatttcaatctc

SEQ ID NO: 40 - DNA, 5507 bp, Arabidopsis thaliana
actagtaacggccgccagtgtgctggaattcgcccttccgggcattgcctgttggcttcggagaaaaaatgcctccaggggttcgccaacttaccgtcctcggaaagtttaaacctttcggtctaatcgccgaagctactgatggtaaatcaccggatgattcctatcagtatttcctcttcgatcctgagctcactggcgagcgagatgatgctgatggcaatgatgccaacttctcgcggcagagagagcacgagctcttcatccgagacaactgcataatctggacaagcggttcgcgggtcctcaagcgttttaccttgtcttctgccgtcattaaggcatgctggagcaaccttggtcgagggacagaagcttttctttgtgtattacaaattgcttgcttaacaatctacaacacatcaggcgaagttgtatctgttccactaatgcgtactgtcaaatcaatatggcctctaccatgtggtctacttcttgagcaagctggtgaagtgaatccaccctcacatgttccattttctcctgttagccccatccttggttctcgtgagatgctgcgccaaagaaaagaagttgggaatagttcaccacaaaacttccattccccagtcgcgcatgaccttattagcaaaagagatatgccatgcatgtcttcccatctgattctaagagatccactagaggaacctgggccaacctacgttgaagagagggggaagttgaccataatgaaggactacgatgagaggacaatttggacaagtgaccgtctacctcttatgacgtcgtataacaaaggcaagatgcaacattctgtgtgggcggccgaatttatagagtcaaaccttgaagcttctgcgtcatgttcaagcggcattgttcctgatgctgttctctcgaagcgggtttcttttcgtagaatatggcaagcgaaaggtgctaagaaagctgcatctaaggtctttttggcaactgataattcagtcccagtaatttgctttctgattctagaacaaaagaagctgttatcggtgggacttcaaactgttgaaatcaataacgaaattctgttcgatgttaagcctgatataagctggagtgtgtctgcgattgctgctgcacctgttgttgtgacacgttctcaagtgaaaataggactgcttccacatttggatatcattgttttatctccagaaaatgacctctttctctattcaggaaaacaatgtctctgtagatatgtattaccttcttggttgggagaaagtattggttccggggatggagagtctgcaaaaacagattcaggtttcaggaacctgaagatcacaggattgtctgatgctgttttaggatctatcaatctctcagttaaccattcacagatctttcggtgtgccttaactggtaaaccttcatcgtcacttgcaaatgattgcatagcagccatagctgagggactacgatccgatctgtacagtttgtttctctctcttctttggggagatggtcattctgacctgcaaggttccagtattcattttgaatgggaagcattatgcaacatttttctggagatctgtcaaaagcctactgttgtgcatcgaaagcaacccaaaacagcatcagagtcctcctgggagtttcttctcatcagcaaatttcataagacctactctaggtttcacaatggtattacttcaataaatcgtttagatctggaaggcattgtcccatttgattccaagatttgtagtgaagaaacactgggcagctcatgtgaactaatggtccagagtttagattgtctccatgcagtttatgagagcttgaagatggataatctacggaaacaggatttgcatcacttggctgttttgttgtgcaatattgccaagtttctggatgagaagtgttacttagattactacatacgtgattttcctcgtctgtcaacaactattggggcgtgcacaaccctttcttctagcagaaaacctccaaatttatttagatggcttgagaattgtttaagacgtggatgtttatcaacaaactttgatgacctcccagatttgatccgtagagatgggtgctccatagtaagctgggcaaggaaagttgtttccttctacagtgtgttatttggtgataagccagaaggacggacactttcatcaggtgtcccctgtaatatcgcgccaggatcatactcctgtaacgaggaactcactatcttagctatggcaggagagagatttgggcttcaccaactggatttgctaccttctggtgtttctctcccgctaagacatgcactggatagctgtcgggaatctcctccagctgactggccagcaattgcttatgtgcttcttggtcgagaagatatggccctatccgtcttcagaaattttagttcatctaaggaatttgagatgcagtcaaatacgagtttgatatcgatgtccataccttacatgctacatttgcatccagtaattgttccatcctctgagtcgattggcttagaaaacactaagattgaggatacaaattctgtggatggttctgtgatagatggaatggagcatatcttcaactcctacacacagctacggtatggccgggatctaagattgaatgaggttagacgtcttttgtgctctgcaagacctgtggtagttcaaacggctgctaaccctactatatcagatcaggagcagcaacaggaccatctttggcacatagcacagaggactgctgttctacccctcgggcgtggagcattcacattatcaacgatacatactcttttaactgaggcgtttactgtaccaaagcttgttttagctggtcgactgccttctcaacaaaatgccattgttaatctagatccaaacataaggaatatccaagaattaaagacctggccagagtttcataacgctgttgctgctgggttacgactggctccgcttcagggaaaggtctccagaacgtggattagatacaataaacctggagagccaaatgctgttcatgctggacttctgtttggcctgggattacagggatatttgcatgtgttaaaccttagtgacatataccaatatttcactcaggaccatgagagcactacggtaggtttgatgcttggtctggccgcttcatacaggggaacaatgcaacctgatattgcaaaggctctctttttccatgttcctgctcgataccaagcttcatatactgagtttgagataccaacacttctacagtctgcagctttagtctccgttggcatgctatttgaaggatcagcacaccagcagacaatgcaattacttttgggtgaaattggccgtagaagtgcaggggacaatgtccttgaaagggagggttatgctgtatctgcaggattctcacttggtcttgtagctttgggccgtggaggtgatgcgctcggttccatggactccttggtcaatcgcttactcctgtatttaggagcaaaagaggaaagatctatccttgtaccatcccttgaagatcaccgaagtgctgcacagataacagacggaagcacttctaatgttgatataactgcacctggagcgataatagctctcacattaatgtatcttaagacagaatcagaggtcatcttctcaaagctctctattcctcaaacacattacgatttggagtgcgttaggcctgatttcattatgctccgtgtcattgctcggaacttgataatgtggagcaggatctgtcctacttgtgattggattcagtctcaagttcctgaagtagtcaaaaatggtatcagccaactccgagatgacatggataatatgtatgaggtggatgttgaagcccttgttcaggcatacgtcaatatagtggccggggcctgcatttcacttgggctgagatttgctggtacgagggatggaaatgctcgtgacttacttaactcctacgctctctatcttttgaatgagatcaagcctctttctgccacacctggaaatgcatttcccaggggaatatcaaaatttgttgatcggggaacacttgaaatgtgtctttatcttatcattatttctctgtcagtggtcatggcgggatctggagacttgcaagtttttcggttgttgagatttctccgcagccgaaactctgccgatggacatgctaactatggcacacaaatggcagtgagcttagccacaggattcttgtttcttggaggcggtatgcgaacattttcaacgaataatggctcactggcaatgttgctcattactctctatccacggttgccttctggaccaaatgacaaccgttgtcacctccaggcattcaggcatttatatgtccttgcaacagaggctcgctggctgcagaccattgatgttgattctggtctgcctgtctatgcccctctagaagtcacagtaaaagagacaaaactttattcagaaacaaaattttgcgagataacaccgtgcattctgccagagcgtgctattctaaagagaatttgtgtatgtggtccccgatactggccccaacaaattgagctagtccccgaagagaaaaattggtggagctttggggacaagagtgatcccttcagttctggtgttatatatgtcaaaaggaaagtaggagcttgttcgtatgttgatgatccagttgggtgtcagtcactgctttcgcgagcaatgcataaggtttttggtttaaggactctgggagaatctaatttgattgctaatagtcatagagaactggattctgatagtgttgatcacttggtcagcactttctcatcagatccaagcctaatagcgtttgcacagttgtgctgtgacaaatcttggaataacagatctgattctgaattcaaggagttctgtctgcaagtgttgtttgactgtataagcaaggatagaccagctcttttgcaggtttatttatctttgtacacaaccattggttcgatggctgatctgcttgtcaaaagcgatagtaacatgtgtgattcactttccatctcaagcctcaaggttgctcttgcctacaatgaggcagtatcaactggaagattggcctcctcaggtggctttgtacagtcaatcttcttagcatcgctgagaaagcgatgtgaagaggttttgaattgctcaacggagctgaagattaatttgaggaattatttgacctcagaagcatggccttatgataagaactcaaagttgcagaaagatataattattctctcatggtatctaaaatggttcaacgtaccatctccatcgatcatcaaagcagcagtggaaaagatcaaatccaagtccaaaaactcaacttcggcaatacctttgttgcgattgttgttaccaaatacgcatattagtgtgattggtgaaattgatagggtctttttcccctcgaattaaacaattgtattgtaa

SEQ ID NO: 41 - DNA, 783 bp, Arabidopsis thaliana
atggcatttgaaaacttaaaaatatctcgtcacatatcttcatcgacaaaaaatttactgaaagcgaaaaaaataatggcagctttggcatcaaacccccaaatgctaactagacaagctcacggtaacaagaaggaacaattgtggaggaaagagagtttaaatttggagaagaagtgtgggttttgtgtgagcgtttacagtaatgaaaagcttgggaggtcacatatggagaaagagtggagactaaaagccttttggtcaaacatagctcagcctacgactttggagatggaacccattaacaacgttgaagaactcgatgctgttctctctcacgcacgccaactctctcagcctatcatcatcgaatggatggcttcttggtgtcgaaaatgtatttacttgaagcctaagttggagaaattagcggcagaatataataaccgagcaaagttttactatgtggatgtaaacaaggtccctcaaaccttggtgaaacgtggaaacatttcgaaaatgcctactattcagttatggaaggaagatgagatgaaagaggaggtgattggaggtcacaaaggatggcttgtcatcgaagaagttagagaattgatcaacaaatttgtctagttctctcttttttttcatttcctaccttttttttttcttttaaaaaaaattaatatgtacagtcagttttcttattttctttctttatacaatttcaaacttaaaaactcctttttttgataatcaagaaatttcacatttttttttctt

SEQ ID NO: 42 - DNA, 1881 bp, Arabidopsis thaliana
aaattcaattatctcattagcttcttccaattcgaaaccctaacaaaagccctaatttacgaaatacgccgaatcgttgacgagaatggagtttgacgaatacgagtacctggagaagacggttgaggaaggagctgggtcgaataagaaaaaggaagagagtgggaacgagaggagcgagaggagttacagaaagagagaaggaggagagaggcagggggaagaaggaggtgaagaagagcgggttagcagtcggagtaagaagtctcgcggagacggcgaagagaacggtggtggtaagagggatcgggagagagagaggcataggagcagcagagacaaggatagggagagggataaggttagagaaggatcgagagataaagagagcgatcgagagaggagtagcaaggagagagataggagcgatagagacaaaccccgagacagagagagaagagagagggagaagaggagcagcagtagatctcggagggaagagaaggaacccgaagtagtggaaagaggaagcagaagacacagggacaagaaagatgagcctgaagcagatccagagagagatcaaagaactgtttttgcatatcagatgcctcttaaagctacggagagagatgtttatgagttcttctccaaagcgggcaaggtgagggatgtgcgattgatcatggacagaaattcaagacgatcaaaaggcgtcgggtatattgagttttatgacgtgatgtcagttccaatggccatagctctgtctggacaactgtttcttggacaacctgtgatggttaagccctctgaagctgaaaagaatctggcccaatctaacagcactacggttggtggtacaggccctgcagataggaaactctatgtgggtaacctgcatttcaacatgtcggaactgcagcttagacagatttttgaggcatttggtcccgttgagcttgttcagctaccacttgatcctgaaactgggcagtgcaaaggatttggatttattcagtttgttcaacttgaacattcaaaggcagcacaaattgccttaaatggaaagctggagattgctggtaggacaatcaaggtttcttccgtctctgatcatattggtacacaagattctgctccaaaatctgctgattttgatgatgatgatggaggtggactggctttaaatgcacaatctagggctatgcttatgcagaagctggatcgttcaggtatcgctacaagcattgtgggctctcttggagtaccagggctaaatggagcagcgtttaatcaaccaggcatgaatcctagtttcccaacatcagtgcttccgacaacagcaatcccttcttttgtcaatgaacatgttggtctgccaagcgaatgccttctattgaagaatatgtttgatcctgcaaccgagacggaaccaaactttgatcttgaaatcagagacgacgttgcggatgaatgttcaaagtatggcccagtcaaccatatatacgtagacaagaacagtgcggggtttgtgtatctgaggtttcaatcagtggaggcagcagcagcagctcaaagagcaatgcatatgagatggtttgcacaaaagatgatatctgcaactttcatgcctcctcatgaatatgaagccaaagccaaggcctgaattgaagacaagtcggatttttgtctttagtagatttcttgttctaactgctatgcagattctcaatctcttgtctgaaatatgttacatagataaaaggattatgaatgaggacctttcattcttcttcttttttttctgtcctcgtttgttgtaactttcccatatattattgatctttgaacttataaaatccgcaatatcaaagacaa

SEQ ID NO: 43 - DNA, 3101 bp, Arabidopsis thaliana
aaacagttttttttctttttacagagtcaatagaacaaaaccagataacagagatagtgacaaaccatccgtgacctcctctgtttttatcctaatctctctgctttctctttcacgtgattgaattctttttctttgttagacattgcttaaatcttcacaactcttttgctttatatatgtctcttctcacattatcctcttcttcatattcaaatctcctctccctaactgttttatggtctcttggattctgaatttgggatcttggggtttcgggttttgaaccatctctttagactttagttacacttttttcattcttttttaagacaaaagagatacgatgaagtctggtctcatcataaccattgctctgttactatacacaagcagctttgttcttgtttctgtagcgaaagagtgtaccaacactcctacgcagctctcatcccatactttccgcagcgagcttctgcaatcaaagaacgaaactttgaagacagagttgttctctcattaccatttaactccagctgatgactctgcttggtctagtttattgccaaggaagatgttgaaagaagaggcagatgaatttgcttggactatgttgtataggaagttcaaggactctaattcctctggtaactttcttaaagatgtctctttgcacgacgttaggctcgacccagactcctttcattggagggctcagcagacaaaccttgagtatctattgatgttggatgttgatggtttggcctggagcttccgtaaagaagctggtcttgatgcacctggagattactatggaggatgggagagaccagatagtgaactccgtggccattttgtcggtcactatttgagtgcaacagcttatatgtgggctagtactcataatgatactctcaaggagaaaatgtcagctcttgtctcagctctatcggaatgccaacagaagtctggcacaggatatctctctgcttttccttccagttttttcgaccgctttgaagctataacacctgtttgggctccttactacaccattcacaagattttagctggtctggttgatcaatacaagttggctgggaacagtcaagctttaaagatggcaaccgggatggctgattatttctatggccgtgttcgtaatgtgataaggaagtacagtgttgaacgacattggcaatcactaaacgaagagactggtggcatgaatgatgttctttatcagctatacagcatcactggagattccaagtatttgctgctcgcacatctctttgacaagccttgctttctcggagtcctcgcaattcaggccgatgatattagtggattccacgctaatacacatattcccatcgtcgttggatcccaacaacggtatgaaatcactggtgatctactccataaggaaatctcgatgttctttatggacatttttaatgcttctcacagctatgcaacaggaggaacatcagtcagtgagttctggcaagatcccaagagaatggcgactgcactgcaaactgaaaacgaggaatcatgtactacttataacatgctcaaggtctctaggaatctgttcagatggacaaaagaggttagctatgcagactattacgagcgcgccttgaccaacggcgtgttgggaattcaaagaggaacccagcctggactgatgatctacatgctcccattaggtaaaggtgtttctaaggctgtgacttatcacggttggggaacaccttatgattccttctggtgttgctatggcactggaattgaatccttctcaaaactgggagattccatatattttcaagaagatggtgcaactccagctctttatgtcacccaatatatatcaagctcacttgattggaaatctgctggtctttcaatatctcagaaagttaatcctgttgtgtcgtgggatccgtacatgcgtgtgacattcactctttcttcttccaaagtgggagtggcgaaggagtcgactttgaatctaagaattcctgtttggactaactctataggtgccaaagtatctttgaatgggcgacccttaaacgtaccaacttcaggtaatttcctatcaatcaaacagaaatggaaatctggtgatcaagtaaccatggagctaccaatgagtatcagaaccgaagctataaaagatgatcggccagagtacgcatctcttcaagccatactctatggcccctacttgttagccggacacacgagcagggactggagcatcacaactcaggctaaacctggaaaatggataacccctatacctgaaactcaaaacagttaccttgtcacactctcacaacaatctggaaacgtatcttacgtgttttcaaatagcaaccaaaccatcacaatgagagtatcacccgagccagggacacaagatgccgttgcagcgactttcaggctcgtgactgataattctaaaccacggatttcgggtccagaaggactaattggaaggctggtcatgcttgagccgtttgatttccctggcatgattgtaaagcaagcaactgatagctccctcacagttcaagcttcttctcctagtgacaaaggagcttctagctttcggttagtatctggacttgacgggaagctaggaagcgtttcgttaagactagagagcaaaaaaggttgttttgtgtacagcgatcaaaccctaaagcaagggacaaaactaaggctagaatgtggttcggatgcgactgatgagaagtttaaagaggcagcaagctttagtttaaagacaggaatgcatcaatacaatccaatgagtttcgtgatgagcggaacacagaggaactttgtgttatcgccattgtttagcttaagagatgaaacatacaatgtgtacttcagtgtgcaaacttgaagaaagaaacccttattgggtgaaaatataagaaagaaaagtctcatttgaaatatagacatgtgtttagatgtttagcctcttaggtttgtttgtgattttgtgttctgcaatgtcatctaaaaatgtatgttgctgttacaataaatataaacaaatgtgtttttat

SEQ ID NO: 44 - DNA, 1559 bp, Arabidopsis thaliana
tggaggagagaagagaacgcaacactttcttcccaatctctctctgctttctctctctagacgtgatctctaattctctaatgtcttcctgcattgccatttcctctaacccctccacaatcggaggaagacgattcctgggagcaagagaaacgatgggacttcccatcggaaaatctcttagagtgagagaattatggtgtgttcttaatgcttaataatcaccgacacagccattgttcttcatcatctccatggattttgattccatttctcgggaaagcacttttctttccccattgcttaaccaaaatgcaatgtggcaaatgaacttgggatcagatgatacaatgggtgttgatgggtcttatccggaacgtcacggagagccagattgtgcttattatataaggactggactttgtaggtttggttcaacttgccgattcaatcatcctcacgaccggaaactggttatagcaactgcaaggattaaaggagaataccctgaaagaattggtcagcctgaatgtgagttttatctgaagacagggacctgcaaattcggagtgacttgcaagtttcatcatcctaggaacaaagctggtattgatggaagtgtatcagttaatgtcttaagctatcctctacgtccgaacgaagatgattgctcttactttttgagaattggacaatgtaaatttgggggaacttgtaaattcaatcaccctcagactcaatcaaccaacttgatggtttctgttcgtggctctccggtttactctgctcttcaatctctaactggtcaaccgtcttattcttggtcgagaacatcttttgttgcaaaccctcctcgtttgcaagatccttctggtttcgcttcaggatctcaaggaggtctcttctcatccgggtttcattcgggaaattctgttccgctcgggttctatgcattacctagagagaatgtattcccggaaagaccaggccaacctgaatgccaattctacatgaagacaggagattgcaaatttggaacagtctgcaaatttcatcatcctagagacaggcaaacccctcctcctgattgtgtcttaagctcggttggccttcctttacgcccgggagaaccactgtgcgtgttctattctcggtatgggatctgcaagtttggtccaagctgtaaatttgatcacccgatgcgagtcttcacttacaacaacaatactgcatctccttctccttcatcatctctgcatcaagagactgcaatcaccacagagctcaggaatctcctagtctcttcttctgtggaagcaaaacccacatcactccctgaaacaacctctgctaaagacaccattgttgatgcacagcactgaaaaccctgtgttttgtctatcttgaaacaatatgtaacatttgttttgctttatcttgtaagcatttatgtacagagatgatatctgatctaatctgattcgccttttgttgtaattttctattggcaacagtttgtgcattaaaaaaaaaaacagtttggtcttaaacgggccttc

SEQ ID NO: 45 - DNA, 489 bp, Arabidopsis thaliana
aaaaaaaaaaactgaaacaaaagaagagtcatcagattttgaagacatgaagttcatgacactaatggtcatcacatttgtgattatcgtcctgtcatctcctattttgatgaaagcagaagagacacagtcatgtgttccgatggagctcatgccatgcttacctgcaatgaccaaaagagaacaaccgactaaagattgttgcgaaaatctgattaagcaaaagacatgtttatgtgattacattaaaaacccattatatagtatgtttactatctctctagtcgctcgcaaagttttagagacttgtaatgttccttatactagttgttaaagctcaatatatttttcaaaataaatattatttataagaaactgaaatcttttgtaacaacaattcattgatgatgatggttgttgggcattttcatgttatcgttgaagcttaaaattgtggtgtttattattaaaactggtttcaagaaaaaa

SEQ ID NO: 46 - DNA, 512 bp, Arabidopsis thaliana
caaacaaagaatctaaatcctatgttcttgttcttcacgatgagaatcttgaaaactcaaagatccagaggaggaagaagaacaagcaagaaatttggaaacagaagaacaagtggaggagaaaagttctcggagaagcttcaggcgcttaagagtcttcttcctccgccgtcgaagatgacggagcagagtcgtcaagatgcttacgtggaagaagattccagtgttggagagacggaacagttgtttcaagaaactgcggattacattgtcagacttaggggacaagtcgtggtgttgcaaaagttaatcgagatttatggatcatctgatcagaaggaagataattttgtttcataatgttcatattaaattatgataatgtttttcattaagcttttttcaatgtgttacgtattttgaacctaatatggtttttaggtagtcacgatgtataatgtttgattttgacgaacgaaaagaatgaaatcggtcaccatcagttacaaagc

SEQ ID NO: 47 - DNA, 1993 bp, Arabidopsis thaliana
acataaactagcaatatttgaatattcatggcatgaccccattattgctatataaaaagagccaagtgtccaattcctgatttcagatgaagtaaaagacaaccaaatatgagtttatgctctgatctcactgagaaattagacgaggagattttagaggacttgacgtccaatgtgaagcaaatacaagacaacgtattggaggagatactcacacttaatgctaacacagagtatcttcgacgttttctccatgggagctctagtaaagagcttttcaagaagaacgtccctgtggtgacctacgaggatgtgaagccttttatcgatcgtgtcacgaatggagagccctctgatattatctctggcaaccccattaccggattccttctaagttctggaacatccggaggaaaacagaagatgtttcctcgtaacaacaagtacttggaaaacataaaattcatcttttattaccgatcgctcgttataagcaagcatatagatggtcttgaacatggaaagggaatggtatttaacttttgtacatcagagaacacaactccttctggtttgccatcatcagctgcatcgacgagcttcttcaagagtgattatttcaagaaccgaccatcgtattggcattggtcttacacaagccctgacgaagtcatattgtgttcagacaccaagcagactttgtactgtcatcttctatgcggtcttgttcaaagagacgatgttgtgaaggttggtgccgcctttgttactattttggtccgagcaataaatcttcttgagaattcttggaaggaaatttgcactaatatccgttttggtcatcttagtgagtggatcactgatattagttgtagagactccgtttcaaagattcttggagagcctaatcctgaattggctgatctcatagaaaatgaatgcaacaataaatcatgggaaggtatagttccaagactttggcctaaagccaaattcatagaatgcattgcaaccggtcaaatggctcaacacatcccaacattggagttttactctaacaagttgccatcgatttcctcgagttacgtatcttctgaaactatgtttggtattaatatgagtcctctttgcaaaccagaaaatgtatcatacacatttctgcccaacttgtcatattttgagttcctacttgttgatgccggtgacaaaaccgaaattgttgatctcgtggatgtcaagttagggtgctattacgagcccttggtcacaaatcattccggcctacacagatataagatgggtgatattttactggtgactggattttataataatgcacctcaatttagatttgtgcgtagaggaaatctgactctaagtattcatttggagataactacagatgaagaccttttaaacgcggtcacagacgcaaagatggttcttgaatcatcaaatttgatgttgatggacttcacaagctatgcggatatttctactactccgggtcattatgttctttattgggagctcaaagcaaaataccgcaacgacattgttgaaatcgataagaatgttttggtagaatgttgctatgtggtggaagaatcattgaacaattcttatagagtatataggagtaaaggtggattaattggagctttggagataagattggtgcagcaaggaacttttgatgctctcatggagtttttcatcactcaaggtgcttcttcaactcaatacaagacacctatttgcatcaaatctactgaggccttggtgattttagaagaaaatgtccatgcttgtttctttactgataagtccctttctttgaacttttcgtcataatctctatattatgtaggcattgaaataaaagctcgtggtaaacaacatgaaacgagatcaaacgcatgcccttgaaactcattttttaagtgtatctcttattattattttatttttatgtaagtgtatcactgttgac

SEQ ID NO: 48 - DNA, 1194 bp, Arabidopsis thaliana
gatgataataatggatgacccccggcaaaaaagataagatttttacagattctgcctcgatcaacagactctaatcagcagcaaatgtggagcgtcaccggagcattgactgtggcggtgccgcctaccgccgccgcttgccgtacgaaaccctttctcatctcctcttcctttcccaagcagacaaagaaactccatctctcttcgccttctctgtctctaccatcatcacatttctcctcctctttcaaaaccgcagctacctccatcgagcaacagtcttctgttaacaagggagagagcaccaagtaccatttcctggtagcaaacgctaaattcatgcttgacgaagaggagcacttccaggagcaattgtttgaacgtctccgttacttcggtgagcgtgaattagtgcaagacttctggcttgtcattgagcctaaattccttgacaatttccccaaaattactcaaagacttcgtcgtcctgctgttgctcttgtttccaccaatggcacctggatcacgtttatgaagttaagattggatcgtgttctgtatgattcctttgaagctacctctcttgatgaagctttggcctccaatcctaccactcttgagttcgataagcctaaaaattgggtggcgccataccccaagtatgaacctggatggtgggataccttcttgcctaaagtaacccaagaatctgcagtatagaactttgctttttgtcttgtttttgcattctccaatctcagctttgtcttagtgcttcaaagttttgtactactgagctcattatccaagtctatatctttcctagtgtagcttctattactcaaagttgcctgtttgatacgtcactgactcaaggttaagcatagaactagacaacaaaaagcatcctcacatttagctccatcaaagtcttaagggtgaccatatttgttgatttctcacgagaatattggcaagaaccttcagttaaagctctaggtattaagttgtctagtcacaggagggcaatatgcctactcgctgaagaactttgcaaaagatctgaattttttggttttcaaaacgatttgtggactcggaacatgttgttactcgttaggtctagtgactggagttgatcaaagtaagttgcacatgtttctgctgaatcaagtgttctatgttgtacttctg

SEQ ID NO: 49 - DNA, 1146 bp, Arabidopsis thaliana
ctccactttttcttcttcttcttttctcaatctttctctttctctctgttcttgcactcgcaaatcgcaatggattcgtttgatttcgataacgtgaaagcagagaaagccaaggcgttgcggcgtttcaaccgcttctgtagaattggccgtttcttccgtgcggcggaggtttgcgtcgctctactcttcatcttttggacattttcgcaacttcctttcgtcgttcaaatctccggagcgtttctccgccgtatcgccgccgtcatatctactcctctgttcgttttcctcctcgggaactccatcgtcgttgttcttctcaccaagtcttccgatcagacaaccaccgccgtcgcaagcgcagaaaccgaaatctaccaggcgttcgtcagatctgtagagaatcgttccaaaccgtccgatgaagatttgacggaggggattgtctacgacgacaaacaggtgatcgttactgatttggattcaaatccgaatctaacggtggatgagaatatgcctcacgtcgagattgactcagattcgagtccccatagtaaggtctatggaagaagcaaatcagacgtgtctggaaaacagagttcaaacatggtgatgatgatgatgaaacgttctcttcagagatcggagacagagaagttctgcaaagaaactgagaacgatgatgactctgaggaggagaagaactatccagaggatgatctgagcaacgaagagtttcagaaaacgatagaagctttcatagcaaaacagaggatgtttcgtcgtcaagaatctttagccgtcgttgtccataacatagcctaaatatctttttatatctatatcaaaaaagcatcaaattctaatataaatcgaatcaaacaacaaacaaacaaagttttgtgaaagttaaccattatggaatcttgtttttttataaaaatattccatgtatgtagtataaatatcatctctatgtacagtaattttagttgcttatgtattaagaaagatatgtaatctacttgtctcaagtgagtgtcacttcctcagttttaatgatacagacttagagtagaaatgttgtctcgccacactcaaaattatgacattaccaaaaaaacctttttaataagctttagt

SEQ ID NO: 50 - DNA, 906 bp, Arabidopsis thaliana
atgtctgatgagttgtctcataagaatcttgatccagtcaagaaatatgcacagcctgtgccacttaaacatggtagttggaggtgtaactattgtcataaagtcacaaatggtggagttaaaggtgcaaaacagcatattcttggaggttttaggaatgttactcaatgttctctagttcctcctattatgagggaagaaataaaagattccatgcttaagaaaactgaaattaaagccactactcaaatgatgccacccccagccacttcatatgacgattatggtgaagaagaagaagcagctgaagttttgggaaatgaaagaagacagccacctgtgaagaaacaaaaaggtctaatggacatgtttgtttgtccaactcttcctaatgtattgaaagttctgaaagatgctaacatgttgtacgatcacctggatcttatggtggatgaagttggggaagctaatgttgtcaaagtggtaatcgacaacgcatcaaactatgtgaaagctagccaactatcaatggcaaaccgacctcatttgtattggacgccttgtgctgctcattgcatatacctcatgcttgaggatataggaaagatttcggaagtgaagactgttatcacacaatgcatcttcaagaatgattatatctatggtcacacttcccttgtgaatatgatgagaaaaattcacaagcgatggaaatctgcaaagatcggctgtaacacggtttgctacgtctttcacacaattgggcagtatcataagcagagaaaaaacttgaggaattctgcgacttctcaagaatgggcagattccaaatggcaaaaggaaataggagcaaggactgtgaagaggatcattatgcaagacagtttctggcacaaggatggttga

SEQ ID NO: 51 - DNA, 1048 bp, Arabidopsis thaliana
gctgtcaccacacaacacaaccaaggagtactactctctaatctccgatcaaacgacgtcgtctcttctctctctctctaatgggtaattgctgcgtcagctccggtaccaccgatcgggaaaacgagaacgtttccgacaagaacacaaccattgtcgaagaagagacagtagtcaaagaagtcttgtcagagacaaccttgttcactccttcctctagtttccgcacttcgacgttcaaagacccggtgaagaccaagatccgagaagatgaggagaaaaaacccggtttcttgaaaatggcttcagacccggttttgatccgacccggttcggttgatcctgaagaaggctctgaggtttcggagatttgtagcttgagtttgagcgagagtgtgtcttcaacggttgtgatgaatggttacgatgaggaacatgtgatgatgaaacagaggaaatctcagagatctccggcgaaaactcggacccaggtcaccggtaataattatccgacccggagaactgatcaatctccacgtaagagaaacaatggtacatgtaatggagcgagatacgggtcgggtgtgagagacccgggtgagagatccggaagaaggtcaagatcgccggcgacgaatagatcggtgatggattcgaatcagagtagtcgggtgggtggggcaaagactaggaagaataatcagtctccgggtcgggttagactagatccggctaaaaacgggttggatcagcaacagcatcagaattacggttataccacagaggaattgttagagaacccgcttgtttcgttagagtgtttcatatttctttgaaaaagaagaatatttcgatgggaataatgtcttctcatttgacgttggattcataattcgtaaagctacttacttaattacgttacctctgtaattcatttctgtgttgtatttgctgatttaaagttataattcggttgaatgatgtaatgttcgagtaaacgaaaattcaagattagaaatgaatacatatgtatgttttaaacaccacg

SEQ ID NO: 52 - DNA, 1248 bp, Arabidopsis thaliana
attcaccacacgcgcttagctatcttctccccctcactgtctgctctaggtcgagattttttagggtttatctccggatttgggttagcgaaatcgagctcacggggttgtctcgattattcctttttaggttgcttgaatctgaagctaatcttgggttaattggattgttagaatcgagacctaaatccttcgattggatcagagaaaatatgtcgcgcgttctcacttgcccaccgcttgtgtttgcaagaaaccacgttggcgttcaaaacttggtcgaatcgactaagcttaaaagaatcacacttgattcaaaaaaggcgcaccggatagagaagaaggaaaagaaggagaagagaaaagaaaagaaagaaactaagcgtgagaaatcgcataaacattcgattaaagcaactgataatcatcacaagctaatatttcttccttccaagaaagtgtcagatgagtctgactcactagagaagagtggtttgacagatgagcttgaggaacctcaaaaacaccttggatatttgtctgatggaagtcagaatagtaagaagaggattagagatgattctcctccggctgttgaaagtctcatcaaagctgcacctgtagcaggtaaacctctacggattagaatggtcttcaaaaaaccaaaggaggaagttcctactctgcctagagaggctgttgtttgctccactacagttgcaaagtcgctcagtcaccaagatgtcataacaagttctatctcaagttcaaaaacatccgagcttgaaaagaatctgccgtcaacatcaatagcggcaatagatgaaacaaagaagagaaagaaacacagatctagcaaagaagatcaatacaatgcattgtttgatggttggactcctccttccatgtgtattgctgatgcatcttcaaatgacaatggtgattattggctatttgggaacaagacgcaagaggtgcttaagcccaaagcagcagtcaaggttgatgatgacacgatgatgagaccgggagattcatcttggcctagagctcaatttttgtctgaagttgggatttattctttaccttatactgtcccgttctaatgctcgattctttttgttctagctttagacttagcttgtacagtgtttgactgtttgtaacaacaattctaatctaacccgattttgatacatcaaaagacttcgtaatacttggttcaattccataatcgatcaagtttcc

SEQ ID NO: 53 - DNA, 716 bp, Arabidopsis thaliana
aaattcagtaaaatggaacccaccaaatttatctataaataagtccccaaacctctcccccaaaaatgcaacaacactcatctttcccaatataagtttttaccaaacaacaacttttgttttgcctttcctcaaaacataattttgtcttattttctaaaccggtaaaagatgtcgctagctatcgcagaagtttacacggtgaggaagtttcacagagagagtatgaagaaaccggccaaacagacggttaccggcgagggagatgaaaagattggcggaggaagtttcaaggaggcgccggtgaagtcaggtgggtgtagaagattcggacggtggttttttgggaagccgggaatgaagaaaagctctgctaaagtttcggatcccatggcgattgagtgatgaagaagaaattaaaacttttctcttctttgccttttttttttttctttctttattttgttttattttcattggtctttttttaatggctttttctagtgtcttctctttttctttattgggtgattttataaatagtcggtaaacattgtacaatatgaactacaaaaatatgagaaaatctatatatgtatgtagaatggatgtattccctaaataccacagctagtttgataagttttatgccaaaccaactaaacttgtatgccacgatatttcgtatttcagaaaatcgaaaattgttatttttt

SEQ ID NO: 54 - DNA, 541 bp, Arabidopsis thaliana
gaaaaacagatatcgttggcttcgtctcttcaacaagatctcaaatccgattttcatcacctatattgaggacaggagattctaacaaacttgagctaaacgtcaagtttcctttactagtttccacagagaaatcatggggttctggacactaatggaaggattgctactatttgcaaacgcactggctatcttaaacgaagaccgttttctagctcccaaaggatggacgctcgcagaactccaccaaacgggcaaaagaaactctctcaaaggccaaatcattggtctcatccacgcctgtcattacatgaggcttcctctcatgctctttaacttaattgtcattgtctttaagcttttctctggttaaaatgatcaaaccccgtttttgaataaactcaatccaaacatttctgcaacttctttagcaattcattttatagtatttaacttcaaaagctcagatttgtatacattattgttatgcttcttacaactacaaacacagtgaaacaaaataaaaacaagttctttgaaa

SEQ ID NO: 55 - DNA, 958 bp, Arabidopsis thaliana
ctcattaatggaagtttcaacatcatccatgtcttcaaaaccagaacaaatgcaaaacccacctcctatgatctcatctcctaggtttcagcctcagataatatctcctcatcatcatgaccagcatcaacatctctcaaatccttatccaacaacatttgttcaagcagacacttctactttcaaacaagtcgttcagatgcttaccggctcatccaccgataccaccaccggaaaacaccacgaagctccttctccggtgaacaacaacaacaagggatcaagtttctcgattccacccatcaagaaaaccaacagcttcaagctttacgagagaagacaaaacaacaacaacatgttcgctaagaatgacctaatgatcaatacgttaaggcttcaaaactctcagagattgatgttcacaggaggaaacagcagtcatcatcaaagcccgagattctctccaagaaacagttcatcatcagaaaatattcttctgtctccaagcatgctggattttccgaagctagggctaaacagtcccgtgacgccactgagaagcaacgatgaccccttcaacaagtcatcacctttgtcattagggaactcatcggaagaagacaaagccattgctgataagggcttttatcttcatccatctccagtctcaactcctagagactctcagccactgcttcttcctctttttccggttgcttctccggcgaggaactcttaatcccgacgatatccatgagtgattttatacatgatattaaattatatctatctccggattttgtttagctataactaagatatctataagtttgatcatagttatggagtgactgtaaattttgtgcggtttttttcactttcaatctcaaaaattaattgcaatatatgtaattgggaggcataagtatatatattcatgatgatactcatatttata

SEQ ID NO: 56 - DNA, 2531 bp, Arabidopsis thaliana
acaagatgagataaatcattcatctcatttcttcaactggctttgcttctttctttcttcttcctcaattataattttttcacaggtttgagatcttatcatagagttttgttttaagtttgtgagatggaattagtgtctggaaaagtagttccaggttgctccaacgcaggcaatcctttccatgagtgtactgctatctgttttgagagagtaaactctccagatgtccacaagaaggagaagaaactctttgggtttggtaagagaactcccagcagggatcagactcctccagctagtccggctcgtggaagcagatcacctctggccagctatttcgccaagaagaaggttgagtcgtcagcagagagttcaccatcctcttatgatcacaccaatggcaacttcttaagtcgcctttccccgctacagggacgcaagatcgagccttcaagcaatgtcgattcgctgccagtttcgccttctctcgctctatactcagggggagactactttgcaaggagggctgatcagcgtggagatgaggatgatgatgtatcaccaaggccttttggaactcagcctaagacccctgaacaccctcttaggacgcctcagcataggccacgcacaccgcaacaccgctctgcacaccaagaggacgctttttcactagaaactaggccgaggactcctgaacgccgatccaatacctctgatactaggccaaggacacccatacatgagtctgcggcaacaggaagaaggcctcaaacaccagaaactagaccaaggactcctgatcaccgatatgccacctatgataataggccgaggacacccatacatgagtctgctgcaacagaaaggaggccccaaacaccagaaactaggccgaggactcctgaacaccgatctgccatccctgacactaggccgaggacacctatacatgagtctgctgcaacaggaaggaggcctcaaacaccagaaactaggccgaggactgcacaacgtagagggaggtcacctgagttcatggaaagatcccccggaccaaggtccaagaccccagagcctcaacctacttacttcgaaccatcctcaaggactccaaaacagcggtccaagacgcctgaacccagccctaggattccccaaactcagcccatgtcccacagatcccttgacaacgctgctcttaaaatgcctcggacagttgaaactaggcctaggacgccagaacaccagccgaggactgtggaaacaaagccaagaatacatgaaagtaggcccaaaactgcagtctatggaggaaggtcacctgatcacagggaaaaaatctcacaagaaatgggtcaaagatcatctcatgcctacaattatcttgggagcaaagctgagtcagtgtacattgagaagaacgaggaatcagttctactctttccagaactgattttgtcacctcaagaaaggccaccctctagacttattacgcttaatcaccgaggatatgaaacacctaacaaacagaaagaacattgtgatgaaatggatgattctgcaagcacagacgacgataaattttcatttgtggatgatcacgacgaacacactgtttcaatttacgctgaaaccacatcgaaatctggaagcagcgaacaagaggaacagcataaagcaaacaacgagccaccggagctgccagatgaatcacagagcttcagtctcgctgagatctctcgtatgaaaggaataattaccaataatgaaataagggacgtgatgcagtctattctatctgagtcttacgtttctgtgggacagtacaaggtcagagctagcgtctcgaccactctacaacacatactccagaagcacggtgacattgcgtctggttccaaactacaatcgcttgctacacgatcctactacctcgacatgcttgcctcggtggtattcgaactccaaacaactcccctgaagtatctcaaggagagccgcgtggtggaaatggtagcgattgttaaagacattgagtccgtgaaaatcaaagcaggttggctcaagcctgtcctggaggagatcgtagaggcggtaaaacactacgatgaacacaagatgagcgtagtggagaaagaggtgtgggagagagatgtgttacttgcgaaacaagaaactgagaaacaggtgaaagaactgggagagaaggagaagaagataaaggagtggagagctaaaatgacggagatggctgcgaagttaggggatcttgatatgaaaagagctcgtctccacaaaagcttcacatttctgagctccaaggtcgacaagtttcaagggaaaccccttcttcaaggcatcttgtaaccaaccaattagtctgaatattcttttgttcatcttgttacccgcaaaataagcgtttgtgaacggtttgctttggaaaagttttatgtattatcaaattttcgtttctaaaaaaactcaagtcttaatatcaaataaaatcccaactttataggatt

SEQ ID NO: 57 - DNA, 1691 bp, Arabidopsis thaliana
actgttcatttctctctattggcatcgacgccattgttggactgaagatgtcaggattcgaagatggattttcagctgaaaagctattctcacaaggatactcatacacctacgacgatgtgatatttctaccacacttcatcgacttttccactgacgccgtctcgctatccacgcgtctcagcaagcgcgtcccactctcgatcccatgcgtcgcttcgccgatggacactgtctcggaatcccacatggctgctgcaatggctgctcttggaggaatcggaatcgtgcactataactgcgacatcgatactcaagcttccgttatccgtcacgctaaatcgcttcaagttccgattgcgtctgatgctgtttttaaatgcccagagcaccagattggttctgttgatgattttggtccttcttccttcgtttttgtctcgcagacgggaacattgacaccgaaattgttgggttatgtttcaaaatcggagtggtcgagtatgaaagatgaccaaaaggaggtgaagatatatgattacatgaagagttgtgagaacaaagattactatgtgccatgggatattgatcttgacaagattgaggcggttttggaagataagcagaaagggtttgttgttctggagaaggaaggtgagactgtgaacgtagtaacaaaagacgatgtggagagggttaaaggatatcccaagttagggtcaggaactgttggtgcagacaagaaatggatggttggtgctgctatagggacaagggaatcagacaaggagaggctagagcacttagtgaaagctggagctaatgttgtggtgttggatagttcgcaagggaactcgatttaccagcttgagatgatcaagtatgtgaagaatacgtatccggagttggatgtggtcggtgggaatgtggtgactatgtaccaggctgagaacttgatcaaagcaggagttgatgggttaagagttggtatgggatctggatctatatgcacaacacaagaggtttgtgccgttggacgaggacaggctactgccgtgtacaaagtctcgacactagctgctcagcacggtgtacctgttatcgcagatggtggcatctcaaactcaggtcacattgtgaaggctctagttctgggagcatcaacggtgatgatgggaagcttcttggctggaagcaccgaggctcctggagcctatgaatatcgaaacggtaggagagtgaagaaatacagaggtatgggttcattagaagcaatgaccaaaggaagcgaccagagatacttgggagataccgcgaaactcaagattgcacaaggagtggttggagcggttgcagataaaggctcagtgttgaagtttataccatacacaatgcatgccgtgaagcaaggttttcaagatctcggtgcttcttctttgcagtctgctcacgagctattgagagataatacccttagactcgaggctcgtaccggtgcagcacagatagaaggtggaatccatggactggtgtcttacgaaaagaaatcgttttagctttccccagtttactttcttatgttacaatgcactacagcacttgtagtgtcaacaataaggtcttgtctcacatgtaatcctgtaatagttgaatcgtgtttcttaatgctatttcactgccccatttcaatc

SEQ ID NO: 58 - DNA, 2579 bp, Arabidopsis thaliana
agtcgcgaatctcaatacttcctcaatctcttcttcttcttcttcactctctctctctctctcgtcaccaccactaacacttccactgattcatcattctccactgagaaacatttctctcgttaattcaacacttcaagtctctcactctccgtttcttcgagtgttctttggttctcctttgcattttcttgcgtctttggactcattactgtttcttactcaatccgaagaatgggaactagatggaggagaatgaaactagctttgggtctaaatctctgcacgtacctcccaagaactctagaggaatcacccactcctttgaattctacagagagactatccgatgttgctctgctttctccacttaactggcctatgactccgacaccttcctctcacggtctgaaattgtccagaaacagctctaaatcttcaaagacatgttctatatgcttaaataagatgaaagaaggaggaggacatgctcttttcacagcagagtgctcgcattcgtttcattttcactgcattgcttcgaatgtgaaacatggaaaccaagtttgcccggtgtgccgtgcaaaatggaaggaaatcccaatgcagcacccaagttttgatcttccttatctctttgctcggtcttataacaatgatgcagctattagccttgtccaccgcttacctagatctcgtggagttatgaatcaaggacgaggtctggctcctgagccgtctatgtttgatgatgatgaacggttagagcagcaactcgtgttttctgggaagagctatagtgatgctttggagaacaatcatcctgtaagaatgatggacttgaagatatatcctgaggtttccgctgtaccacgagctgactcccgtgagaagtttgatgtattggtgcatcttagagctgctgccatggttactggaaatgctaactctctcaacaatcagatatctaggtatcctcgagctccagttgatcttgtcacggtgcttgacatcagtgggagcatggctggaactaaactggctctactcaaacgagcaatgggttttgtgattcagaaccttggttcaaatgataggctctcggttattgctttctcttctactgctcgtcgtcttttccctttgactaagatgtctgatgctggtaggcagcgagcccttcaagctgtaaactcagtggttgcaaatggcgggaccaatatcgctgaaggtcttaggaaaggtgtcaaggtgatggaagatcgaagagataagaatcccgttgctagcattatccttttgtctgatggacgagacacctataccatgaaccaagctgatccaaactacaagttgttacttccattgtctatgcacggttgtgaaagcaagcggtttcagatcccggttcattcttttggctttggatcagatcatgatgcttcactgatgcattctgtttctgaaacctctggggggactttctctttcattgagagtgaatctgtgatccaagatgctcttgctcagtgcattggtggacttttaagcgttgcagtgcaggagctacggttagaaatcgagggtatgtgctcagatgttcatctcagctcaataaaagccggaagttaccagagccttgttagtggtgatggtaggtctggatgtgttgatattggtgatctttacgctgatgaagagcgggatttcttgatatctgtcaacatccctcctcaaaaagatggaaacgagacaccacttctcaaaatgagatgtgtctacaaagatcttttgacaaaagaaattgtgacgcttcaaagtcatatgctcaagattcaaagaccagaaaccgttggtcaagaagttgttgtttccatcgaagtggacaggcaaagaaacagatttctagctgcggaggcaatggtaaaggcgagagctttagcagaaagagaagatttagccgcaggtgtcactgccatccagaatttcagagtggcgttggcagagacagtctcagcgaaatcgggtgatgggttttgtgtggctttggacagagagctaaaggaaatgcaagaaagaatggcgagtaggcatgtctacgaggtatcgggaagagcttacattctttctggacttagttcacactcatggcaaagagcaacatcaagaggagaatcaggagatggttcaagctttgtccaagcttattaccaaactccatcaatggttgagatgttacacagatctcaggctacatcgcatcatcatagactcatccagcctttgtttgcatctcaaccaaagccaaggtgaaaaaataagcaagattcaatgtaaaaatgtttcagctatttttgatctctctcgaaactttctggtctctctttgggcgtgaggaggagaaatgtgaatcgaagttgggtttagagggccttactatttggtgatttacctggttttgtaagttggtcttgtttcagtatttgtgtgtaactgtgtatatatggtcgtataaaagcttattttccactcttaaatgtgtatgtctgcattttagtcgaaaccatcccatttatttt

SEQ ID NO: 59 - DNA, 1423 bp, Arabidopsis thaliana
aaccatatgaatctcacgatcaaagataatatctcatcatctatatagtatttgtctcgatattagagacgtacacactttgtttatactcaaatcaatatgggatctttcgtgaaagaagaaacgtcgtcgttgatgacagattttttggagaagtgcggtggttatgcggtggtggatggagggtttgcgacggagctacagcgccacggagctgatatcaatgatccactttggagtgctaagtgccttattacttctcctcaccttgttacaaaggtgcacttggattaccttgaatctggagcaaatatcatcataacagcatcttaccaggcgacgatacaaggttttgtggcaaaaggtctatcggtgggagaagcagaaaatttacttagaaggagcgttgaaatcacgtacgaggcacgtgagattttctacaacagatgcaccaagggttcatgggatttcgcctacgctggaaaagcttcccggagaccaattcttgtcgcagcttccgttggtagctatggagcttatctcgctgacggctccgaatacagtgggatatatggagattctgtgagtaaggagacattaaaggatttccatagaagaagagttcaaatcttagcaaaatctggagccgacctaatagcattcgagactattccaaataagctcgaagcagaggcttatgcggatcttcttgaggaggaagatatcgatattccggcatggttctcgttcacttccaaggacggagtcagtgtgccacgaggagattcagttgtagaatgtgcgaaagtggcagattcatgcaagaacgtggtggccattggaatcaattgtactgcaccaagatacattcatgctttaattatctccttgcgccagatgacacgcaaaccaatcgttgtatacccaaacagcggggaagtctacgacggtctgaacaagaaatggattaagtcagagggagagtcagaggaggattttgtgtcgtacgtgagtaaatggagagatgcaggagcttctctgtttggaggatgttgtcggactactccaaacaccatcagagccattgctaaagttctctccgacgaaccttctgcagcatcaaaacccaaattcgggcaatagacttgtcaacggtgaatttctatgcttgtgatgtcaggaaggagtttaaaatgtacaataacgcaagcgtagttctgtaatctactaatatgttgaaactataaataatggtaaactatgttagagacaactgtgtaattagcgtatgataataatggagtttaaacgataatttgatgttatagtaagcatatttttattattgtgctgtacgaatatataaaagtgattataggctgtattaattttgtaagctatgaggaataaataagcttttctt

SEQ ID NO: 60 - DNA, 1011 bp, Arabidopsis thaliana
atggcgacagataaggcgatctgtcgacggttactttactatctctttgtcacccctttggtgacggtttacagggaattcgctgggaaagtggtctgtttcttcaccgcccactccctggtagttatctccacggtggaatccacgattcatcgtgatgctacttcttcggcttcaggcaacgttctattaaagtttcgatttacaatcccagaatccacaaatctcatctctcttaaacctccaaaccacttccctttacgattctaccaacctctatcacaaatggcagacaatctccgtcgtgcggttcaagacatcaatttgggagttgatgacattccttttgctctaccggaagacattgtgaatcatgcggttgcagaaaaccgcttcatcctgtttggccggccggttatgcccagaaggcaaaatctccgttccattgtagcatctatgcctcgaatctggggtcagagcgggcttgtccatggcagaatcatggaaggacgccagtttcatttcatctttacgttagaggagtctctcgaaacggtgctacgtcgtggtccctgggctttcaacgattggatgattcttcttcagcgatgggaacctcagattcctctcttcccttttatccctttctgggttcagattagaggaatccctttccaatttctcaatcgaggtgtggttgagcacattggcagagctttgggtcaagtgttggatactgatttcaatgtggaagttgtagccagaatggactttgccagggttcttctacattgggatatcacccaccctcttcgcttccaacgacatttccaattcacggctggcgtcaacactctcctcaggtttagatatgagcgtctccgtggtttctgtgaggtatgtggaatgttaacacacgactttggtgcctgtttgattcaaaatggtggtgaagagcaagctgatgatgatgatgacgacgaggaacacccgcagacataccataattag

SEQ ID NO: 61 - DNA, 1066 bp, Arabidopsis thaliana
tgactcagagatcaacaaaacctagtttttgaatttgtttcaatttttctcaaattactctgtttttgagatctctgttttcgttaaattatgtctttgaggtcagaatcttcaacggcagagaagataacagaggatccggtgacgtataagacagcacaaagcagcgtgacgtgcatctaccaagcacatatggttggattctggagaaacgttagggttctatggtctaaaaatctcatgaaccattccttaaccgtgatggtcactagcgtacaaggcgatatgaattactgttgcaaggttgatcttaagccatggcacttttggtacaagaaaggttacaaatcgtttgaggtcgaaggaaaccaagtagatgtctattgggattttaggtctgcgaaattcaacggcgggcctgagccgagctccgatttttacgtggcgcttgtatccgaggaagaggttgttttgttgttgggtgatcacaagaagaaagcttttaagaggactaaatctagaccttccttggttgacgctgccttgttctacaagaaagagaatgtgtttgggaagaagattttttcgactagggctaagttccatgataggaagagagagcatgagatcgtagtggagagctctaccggggcgaaagaaccagagatgtggattagcgtagatgggatcgttttggttcaggtgagaaatctgcagtggaaatttagagggaaccagactgttttggttgataaagaacctgttcaagtgttttgggatgtgtatgattggttgttcagcacccccggtacggggcacggcttgttcatctttaaaccggagagcggtgaaagcgaaacgagcaacgaaaccaagaattgcagtgcttcttcttcttcttcttcgtcggagttttgtctctttctttatgcttggaaattggagtaagtctaaatgttttcaatccaaaagcttgcattgatttttttgcctgactgtaaattcacattcaaaaatcaatcttagcgtgtgaccgactcttgataattttgagttgtcaaattca

SEQ ID NO: 62 - DNA, 1436 bp, Arabidopsis thaliana
aaaaacttcaaattaaaagcttcgtgtcttcataaaaccctaatctcgcgacttcgtctctatccccaaaaaccctttcctctcttccttcttgtgtgagaccgagaaaaaaagatgactaagaacagtaaccacgacgagaatgagttcatcagctttgaaccaaatcagaacacgaagatacgctttgaagatgctgatgaagacgaagttgctgaagggtctggtgttgccggcgaggaaactccccaagatgagtccatgttcgacgccggagagagcgccgacaccgctgaagtaactgatgataccaccagtgccgattactacttcgattcttactctcactttggaatccatgaagagatgttgaaggatgttgtgagaacaaagacttatcagaatgttatttatcagaacaagtttcttatcaaggacaaaattgttcttgatgttggagctggaaccggaattttgtctctgttctgtgccaaggcaggagctgctcatgtctacgctgttgagtgttctcaaatggctgacatggcaaaggagattgttaaagctaatggattttctgatgttattacggtattgaaagggaagattgaggagatagagcttcccactcctaaagtggatgtgattatatcggaatggatgggttactttttgttgtttgaaaatatgttggacagtgtcttgtatgctcgtgataaatggcttgttgaaggtggagttgtgctaccagacaaagcctctctgcatcttacagccatagaggattcagagtacaaagaagacaaaatcgaattttggaacagtgtgtatggttttgacatgtcatgtattaagaaaaaagctatgatggaaccacttgttgacacagtcgaccaaaaccaaatcgtcaccgatagtaggcttctaaagacgatggatatctcaaagatgtcctctggtgatgcttccttcacagctccctttaagcttgttgcacaacgcaatgactacatccacgcccttgtagcctactttgatgtatcgtttaccatgtgccacaagctgctgggcttctcaacaggaccgaaatcccgagctacacactggaaacaaacagttctgtatctagaagatgtgttaaccatatgtgagggtgagacaatcactggaactatgtccgtttctcctaacaagaagaatcctcgagacattgacataaagctaagctattctttgaatggccagcattgcaagatctcaaggacccaacactacaaaatgcgttaaagttctctcataagaagcagaacttcagaagatacaattctcatattgtgatttagtttttatatttctttttctccagattacaactttccatttgcttcacattgcaacatttgcttcatctcaagttaaattaatgattttgctct

SEQ ID NO: 63 - DNA, 1631 bp, Arabidopsis thaliana
actcaccaaaatccaacgtgatcaatatggaagctctaatgcttatcttcacgttctgtttcatagttctctctctcatattcctcatcggaagaatcaagcgaaagctcaaccttcctccgagtcctgcatgggcgttaccagtgatcggtcacctccgtcttctcaagccaccactccaccgtgttttcctctccgtctctcaatctttaggcgacgctccgatcatctccctccgtctcggcaaccgactcctattcgttgtctcttcacactcaatcgccgaggaatgcttcacgaagaacgacgtcatactcgcgaaccgacaaaccaccatttctacaaaacacatctcatacggcaactccaccgtggtctctgcttcgtacagcgaacactggagaaatctccgccgcatcggcgccttagagattttctcggctcatagactcaatagcttttcctctattcgccgcgatgagatcaggaggcttataggccgtctcttacggaactcttcttacgggtttactaaggttgagatgaaatcaatgttttctgacttaacattcaacaacatcattagaatgctagccggaaagtgttactatggagacggtaaagaagatgacccggaggccaaacgcgtgcggacgcttatcgcagaggctatgagttcttctggtcctggaaacgctgctgattatataccgatcctgacttggatcacatattccgagacacggataaagaagctcgctggtaggcttgatgagttcttgcaaggattggtcgatgagaaacgagaaggaaaggagaagaaggagaacacgatggttgatcacttgctttgtctgcaagaaacccaaccagagtactacatggaccgcatcatcaaaggaaccatgctttctcttatagcaggggggactgatacaacagcggtaacattggaatgggcattgtcaagcttgttgaacaatcctgaggtgctgaacaaggccagagacgagatcgacagaatgatcggtgtagacaggcttttggaggaatcagacatcccaaatcttccttatctacagaacattgtatctgaaacgttacgtctgtaccctgcagcccctatgctgcttcctcacgtagcctcgaaagattgtaaagttgggggatacgatatgccgcgtgggacgatgctattgactaatgcatgggctatacacagggatcccctgctatgggatgatccaacgagcttcaagccagagaggttcgagaaagaaggagaggctaagaagctaatgccgttcgggctaggaagaagggcatgtcctggatccggtttggctcagcggctagtgaccttgagtctcgggtctttgattcaatgttttgaatgggagaggattggagaagaagaggtcgatatgactgaaggtccaggactcacaatgccgaaagctagaccgttggaagctatgtgcagagcacgtgactttgttggtaaaatcttacccgactcctcttgagtttttgtatgtaaaatgctaatacgttgcttagcaacggtaacgaattaaatgaaacgtattagcataataaaaatcagagacaaaaatcatattctaatttcc

SEQ ID NO: 64 - DNA, 1722 bp, Arabidopsis thaliana
atcacaaccaaattccttagagaaaaaggaagagaaaggtcaaagatgttttactatgtgattgtccttcctttagctctctttctcttggcttacaaattattcttcacctccaaaacgaagcgtttcaacctccctccctctccaccttactctctcccaatcctaggccaccacaacctcctcaagccgccggtccaccgtctcttccaccgcctctccaaaacacacggcccaatcttctccctccaatttggctcccgccgtgccgtcgtaatctcctcctcctcactcgcaacacaatgcttcacaggccaaaacgacatcattctctcaaaccggccttgtttcctaaccgctaaatacgtcgcttacaactacacaaccgtaggaaccgcgccttatggcgaccactggcgtaacctccgccgcatttgctccctggaaatcctctcctcgaaccgtctcacaaacttcctccacatccgtaaagacgaaatccaccgcatgctcacgagactctcacgcgacgtcaacaaagagatcgagctcgagccgctcttgtccgatctaacgttcaacaacatagtaagaatggttacagggaagagatactacggcgacgaagtccataacgaagaagaggcaaatgttttcaagaaactcgtcgccgatatcaacgactgtagcggcgcgagacatcccggagattacttgcccttcatgaagatgttcggagggagctttgagaagaaagtgaaagctcttgcggaagccatggatgagatcttgcagcgtttgcttgaagaatgcaagagagataaagatggtaacactatggttaatcatttgctctctctgcaacaaaatgaaccagagtattacactgacgtcactatcaaaggcctaatgctgggcatgatgatcgccggaacagacacttccgctgtgacgctggagtgggcgatgtcgagcttgctaaatcatcccgaggctttggaaaaagcaaaactagagattgacgagaaaatcggacaagaacgtttgatcgatgaaccagacatcgcaaacttgccttaccttcaaaacatagtgtcggaaacattccgattatatccagcggcaccgcttctagtaccaagatcaccaacagaggatattaaagtcggaggatacgatgtgccacgtggcacaatggtgatggttaatgcgtgggctatacacagagatccagagctctggaacgaaccggagaagtttaaaccagagaggtttaatggcggagaaggtggaggaagaggagaagacgttcataagctgatgccgtttgggaatggacggagatcgtgtcccggcgccggactagggcagaagatcgtgacattagcgttaggttcgttgatccaatgctttgactggcaaaaagtcaacggcgaagcaatcgatatgacggagactccggggatggcaatgcgtaagaaaatacctctatctgctttgtgtcaatctcggcccattatgagtaagcttcaggcccatttaaaaggttaggtttgttttcttcttaaagttctttttagttttctgttttctatgcatggagatgtgagattttgctgcgtttgtgtaacgaaggatatttgtgtaatgcgaacaaatgaaattccaatgttttgcccatatgtaatggtttataagatttgtttctctttaatggtttct

SEQ ID NO: 65 - DNA, 960 bp, Arabidopsis thaliana
gtcgtcgtcctcctaacatgctccatctccttcttctctccgacgaagaacattccaccaccaatagcatgcccccttcctcctccgcctctagatccgcctccaatcacagctcctcttcctcctcctcctcctcctctctccacctctgcaagcactctccttccgcgactctcgacctcctcatcctaatcctcgtcctcttctccggcgctttcctcctctcctcttacttctcctatctcttccactccttttctctcctctcctctcacttcccttccctctcctccttgatcttctccgacgatgaagatctctcctcgatccctcccgcttcctacttcttcgccttcgccgtcttcttcgccgcttcaattgcgtttctcgacctttgttgtggacccagatcgaggaagtgtcggaatcccaagtgtaaaggtttgaagaaagcgatggagtttgatttgcaattgcagacggaggaatgtgttaaatctggagctactaaggagatcgatcgattgccatggaaaggaggtagtgagagcaatcctgattacgagtgtttgagggctgagcttagaaggatggctccgcctaatggtcgtgctgttttacttttccgatctagatgtggttgccctgttgctaagcttgaaggttggggtcctaaacgaggccggcgtcataaaaaatcgcaagcgaacttggctctgaagggaggggtcgaccatcgctgatcaggtcgataggaactcttatatctatcattataaatttatcacattcaatgtttgcatagttcatcttggaaactagagaaatccagacagctttgtttgcggattttttaatttcttttaccttagaaatgtcccaatattacaacttgaacacttaactttttattgaactacattacataccacgcaaaaaaaggcagaaacatgtttgttc

SEQ ID NO: 66 - DNA, 730 bp, Arabidopsis thaliana
acttccctctttctctctttcactttgctctgttcactcagagcatcaaataaacaaaagagagaaaccaaaaccacacaagactaacgatgttgctagggaagagacagagaccaccaataaagagaaccacgagtctatctgagattaagttcgatttgaatcaacctagcgaacaagaaccatccgatcatcagattcagcttgtgaacgttgatgaacatcgtcaagttcatcaaagattgttagatcaacggcttttagcgatggtctcaccaagaggtacacagagaagacactcaagtgattattctgaagattttctaagatcttgctctctttgtaaacgtcttcttgttcatggccgtgacatctatatgtatagaggagatagagcgttttgtagtttagagtgcaggcaacaacaaattacagtggacgagaggaaggagaagaagaaaggttcggtgaggtccaccatcgtcgtcgccaccggaaccaccacaggagagagagtttccgccgccgtgtaggtctcttttacatatgttatatattatcggtaatgattgtattatatggttcttgttttatgtataaaaagcattgagcactattgactgtgattaaccatgttaatcatcctttaaaccttgcttttgatcttaagaattattgtattatgcatattaattagatttgtgttctactgattattctacttctaact

SEQ ID NO: 67 - DNA, 2031 bp, Arabidopsis thaliana
gagcaaagactcaatctttcatctctagattcttggcgattctcgctacatagtactttggtaaagagtgaaatcaaaggttggttttgagatatgggaggaccagcttacgattgtctgaccaaccctttaggagccgtccgattctccttcgtaaatgctctgtcttcaggctacgatccggcttcgtctgtcggaaaagactggggtgtcgttgatttgttccgtcactacttctccgacgaatctgctatctcccaggttccaattcttgattcgtcaagtattaagtgggtgcaacccaagactcttgttcggtttcgtggaatgatacaggacatgcttgggaatgaattctatgctggtgcttacaaggatgattcaacatggagaacaaacaagtacagtgatgtttcacagtttcctgagggttcttccactgaaattcaagtttgggagcgtcgcttgctttactgtgttccagttccgggaaaaaaccagtggactgaatgttcttcacaagagctaaaaaaccggtttttggatctaactggccaaaacagggaaaagcgtgtgagggtggatgaagaaatgactgattccatggactccagtactttagaagctgggcgtaatggttctccttttaagaaaatgaaagtgggggaagctacttcatcagcttcagaatctcaggttccacaaacttctggtattccgcctgctacaagtgcagattctctgccttgtcttgtcaagatctatgattctccagagtcagatttgaagctaaatgatgtggttgaatttcttggagtgttgaccttcgatccaattgttatgatggatacagatacacttgatgaaaactctgatgctctttctgaagctgaatctgttcagatgccctctggaaaggtcccacgcctccattgtcttatccatagaaagcttgaaacacagcatttcctgcatggttcttcgttattaccagagccaaaatccccccaaatattcaaagagataagagagagtttgatgaagtaccttaccggtctacttgggaatgatcacattgccgcacagttcctattattgcatctcctgtcaaaggtgcatggaagagtagataatgttgctgttgggaagctttctcttaatctcatacaccttaataaagaaagcatgtctatcttcggtacccagctcagtggtgccctcaaaagcctcctaccgttcacacaatctataccacttactattgagtatctgaacactgcctcgttcggtcccaagaaagactatggaatcaacagattgatgcctggagttctacaaattgctgatggtacgcacttgatattggatgaaacagagttgcaaccaggcaccttgaactctgttggagttgagaatgcaaatctgcttaaaaacctcttggaatgtcagaaggttgagtatgatttccaatattacaaaatggaaatggccactgatgttcaaatgctcatattctccgagggaaagtcgaacataatgcccgccgatttggttctacctcttcaaccttctcaagtgaattcattggaagtcatcacaccagaaacagctgaaacttggaggtgctacttagctacttgcaaatcattatcacactccattgggcaagagttgcaacaggtggtggagaatgatttggttgcagctagacaaacagatcgtagtttaggcagccaagacttgagcagattgttgacaatggctcgtatgatgtctgtgagttatggtgagactacgctttcactagagcactggcaaatggtgttggaactagaaagacttagaaaggagaggctcaagtaaaaccaccgtaacgaacaagatgtattatggtttcgagactatttggatattgtaattttcactaagttatctgagtaagaagaaccatatcgtttcatttcctatctatttattaaggttcaacttttgagctattgactggtaatggaaaatgtttgagaaagaaga

SEQ ID NO: 68 - DNA, 1520 bp, Arabidopsis thaliana
caaaatgaatgatgattagatttatgatggtctatatatatggttctagatagatctaataatcacacttcatcttgcaaaaatataattcacacaagggactttaaacatgggtgttctaagcatgaagggaggagatggagaacacagttatgctaataattccgagggacagaaacgtcttgcttctgatgcaaaaccggtggtggtagaaaccgtaaaagaaatgatagtgaaaacagattttcctggttgtataaaagtggccgacttaggatgttcttccggggaaaacacgttattggtcatgtccgaaatagtcaacacgatcattacatcataccaacaaaaaggcaaaaacttaccagagatcaattgttgtttgaacgatctcccagacaacgatttcaacactactttcaagttggtccctgccttccacaagttgctgaagatggatgttaaagggaaatgcttcatctcaggagtcccaggctcattctactcaagacttttccctagcaagtctctccattttgttcattcatctctttgtctacattggctttccaaagttcctgatgggcttgaagataacaagaagaatgtgtaccttagaagtccatgccctccaaatgtgtacaagagttatttgactcagttcaagaatgatttctctttgtttctgagactgcgtgcggatgagactgtgccaaatggacgtatggctcttactttcgtgggcagaaaatctttggatcctttatctaaagattgtttccaaaattggtcgtcgatatctgattccctcctcgacttggtttctgagggtattgtgaaggaatcggatgtagattcttttaacttgccattctacaatcctgacgagagtgaggtgagggaagttatcgaaagcgagggctcgttcaaaatcagcaattttgagacaatctttggtcttctcttttcatacaaaactggtcgtactgaagtgaaagatgatgatgataatttggaccaatcatgtcgatttgaagtcattcgaaagagggcaagcatcataagatccattactgaaccaatgcttggtgctcattttggagacgccattatggatcgtctgttcgagaggtatacataccatcttgccgagcgttacgatactttgcgcaacaaaccaactgttcagttcttcgtttccttgacaaggaagtaacaaacctatgaggagacagtaagtgaagcaaaaaacattatattatgaataaatcatttccttaattttctcttatttggtattttgaaataattacagtggtgatttgttccttgttggtctggcaaaagttcatgtttgtttgtaggaacatttgttacatcttctttatttaaggaaaaaaaaacaaaggcaaattcgcttaaaaaagttggccaacaaacaaagccaatttaatgaaaatgtattctcatgattgtaatttgagtgatatatatatatataatgtttgtgtgtggttttt

SEQ ID NO: 69 - DNA, 4091 bp, Gossypium hirsutum
tcgcggatccgaacactgcgtttgctggctttgatgaacatattccattcattatttacaaaactcctctatatccctttttgtatttttcagacaaaaaaaaaaaaaccatgacacctccggccggttcattttccggcgaccgagaaaatgacggcgatgccacgaagaagaagaagaagcaacggaaagttccattgttgaagctgttttcatttgctgatttttatgaccatgtgttaatgggattgggatcactaggtgcatgtgtgcatggtgcttcggtgcctgttttcttcattttctttggcaaattgattaacattataggaatggcttatcttttccctaaagaagcttctcataaagttgcaaagtattcgttggattttgtatatctcagtgtcgctattttattttcatcatggatagaggtggcttgttggatgcataccggagaaagacaagcggcaaaaatgaggatggcatatctaaaatcaatgctaaatcaagatataagtttatttgacacagaagcttcaactggagaggtcatttctgcaattacaagtgacattattgttgttcaagatgccctttctgagaaggttgggaatttcatgcattatataagcagattcatagcaggtttcagcattggctttgctagagtatggcaaatcagccttgtaactctctccatagtcccattgatagcccttgctggtggcatttatgcttatgttgccactggtctcattgctcgagttcgaaactcatatgtcaaagctggtgaaattgcagaagaggtgattgggaatgtaagaacagtacaagcatttgcaggggaagaaagggctgtgaaatcatacaaggatgctttgatgaacacatacacatatggtaaaaaagctgggttaacaaagggtcttggccttggttcactgcattgtgtgcttttcgtttcgtgggcattgcttgtttggttcacaagtattgttgttcataaaaacatcgcaaatggtggggattctttcactacaatgcttaatgttgtcatttctggcctgtcgttaggacaagcggcaccagacatatctgcgtttattcgagcaagggcagctgcgtatcctatattcgagatgatagagaggaacacagttagtaaaaccagctcgaaaacgggccgtaaactaagcaaagtggaggggaacattgagctcaagaatgtatctttcagttatccgtctcgccccgatgtggtcatcttcgataggttctgccttaacatacctactggaaagattgtagctcttgtcggagggagtggctcggggaaaagtacggtcatatcattaatcgaaaggttttacgagccacttgcaggagaaatattgttggatgggaataatatcaagggccttgacctcaaatggcttagacaacaaattggtttggttaatcaagagcctgctctttttgctactaccattagggagaacattctatacggaaaagacgatgctacagtcgatgaaataacgcgtgccgcaaaactttctgaggccattgcctttattaacaatctccctgatagatttgagactcaggttggtgaaagaggaatacaactatcaggtggacagaagcaaaggattgcgatatctcgggcaatagtgaaaaatccacctattcttttactcgatgaagcaacgagtgcccttgatgcagaatccgaaaagagtgtgcaagaggcacttgatcgtgtgatggtggggcgaacgacggtggtggtagctcacaggctttctactattaggaatgcagatgtgattgctgttgttcaaaatgggaagattgttgaaaccggtactcatgatgagcttatttcgaacccgaacagtacttactcttcgctcgttcagcatcaagagacatcgcctttgcaacgctacccttcacaaggtcctactttaagtaggccactcagtgtgagttattcacgagaattatcccgaacaaggacgagctttggtgcaagttttcgttctgaaagagactcagttagccgtgctggtgctgatggaatcgatgcagggaaacaaccttatgtttcacctggaagactgtattctatgataggacctgactggtattatgggttctttggtaccgttaccgcattgattgccggagctcaaatgcctctatttgctctcggggtttctcaagctctcgtagcctattacatggactgggaaacaacgtgccacgaagtcaagaagatcgccatcctgttttgttgtgcttctgtcataacggtcatcgttcatgcaatagagcacctatgttttggcatcatgggagaacgactcactcttcgtgtgcgtgaagggatgttttcagccatcttgaaaaacgagattggatggttcgatgacttaaacaacgcaagttccatgcttgcatctcgtctcgaaaccgacgccacgtttctaagaggtgtagtcgtggaccggacatcgattctcatacaaaacgtaggcttggtcattgctgccttcatcattgcattcatcttaaactggagaatcacacttattatcttggccacttttccattgatcataagtggtcacattagcgagaaactattcatgcaaggctacggcggtaacttgagcaaagcatatctaaaagcaaacatgatcgccggcgaggctgtcagtaatatgcgaactgtcgctgcattttgcgctgaggaaaagatccttgatctttatgcccgtgagctcatagagccttcggaacgttcatttaaacgtggtcaaattgcagggatattctatgggatttcccagttcttcatcttctcatcttatggccttgccttatggtatggttctgttttaatggggaaggagctagctagctttaaatcggtcatgaaatcgttcatggtgttgattgtgacggcattagccatgggagaaacgttggcactggtcccggaccttctaaaagggaaccaaatggtggcatcggtgttcgagattatggaccggaagacgcaggttgttggggatgctggcgaagagctaacaaatgtggaaggtaccattgagctaaagggtgttcactttagttatccgtcgagaccggatgtggtgatattcaaggattttgatctgaaagttcgttcagggaagagtatggcgcttgtgggacaaagcggatccggtaagagctcagttcttgctcttatacttcggttctacgatccaacatctgggaaagtgatgattgatggcagagacattaagaaactaaagctcaaatcccttcggaaacatatcggattagtccaacaagaaccagctcttttcgccacttcaatatacgaaaacatcctatacggcaaagaaggagcatctgaatctgaagtggtcgaagcggctaaactcgccaatgcacatagtttcataagttccctccccgaaggttactcaacaaaagtcggcgagcgaggggtacaactctcgggtggtcagaaacaaagagtagccattgctcgagctgtcctcaagaaccccgaaatcttgctgctcgacgaagccactagtgctctcgacgtcgagtcggagcgcgtggtgcagcaagctctcgaccggttaatgaggaaccgaacaacggtaatggtggctcataggctgtcgacaattaaaaatgcggatcgaatatcggtcattcagggtggacgaataattgagcaagggacacattcgagcttaatcgaaaatcggaatggaccgtactttaagttaatcaaccttcagcagcagcagcaaatggaacaatagtgtcaaatttcagtaagaaaatgaagaaacaggttatgcagttgctttgtttaaatattttactttctttttttcactaaatttggattcatcttaactagagccattctttccatatgaagaaaataataataatacatatggaagaatattgtaacaagtgggatttttttacaataacatggatatgattaaaggtgttaataaatcagattggattgagtttgggcc

SEQ ID NO: 70 - DNA, 673 bp, Arabidopsis thaliana
ctttgattactatattatttttttggaatttattctggtgacattaatgttctatcctccacgcggttctcataaaccgacttggcttctttatttttcctttatctttctctatatatttacacacacacgcatttgtgcagagatattcaaagattagaaacattcttgatagatacaaaaaacattttttcagacacaaaatcataaaatctttgcctttagtagatcaaagttctttacattaatcgttagaagatgagccagtacgatcacaaccagtctgcaggagctaacccaccgccaccgatgtctacctgtacatcaccaccaccgccgattggttacccgactaaccaaccgagtcatggttcggtagctcagggtaaagtggaaaccaagtctaagggtgacggattcttcaaaggctgtcttgcggccatgtgttgctgttgtgccctggacatttgcttctaagccatttgggaattgggatggtctatttatgacgagtttatgtgaatgtgatgtgaattattattattctctccagccttattgtataaattctctattttttgtttattattttcttgtaatactttgtgagacgaacatattatggtttgtatttggatctctactctctagtacttaaattaatttgtcttgc

SEQ ID NO: 71 - DNA, 1590 bp, Oryza sativa
cgcgtgctcgccttcccctcgcctcctcgcctcccctgtgtggagcagttactgcgagcgagccggaccaaccactctgctctctctctctttctctctcgacgcctcgtcggggccaggaggcggagacagcaacggctcaccgcccggtgtcgcgggggaccccacgcgccagcgagacaggccctccacccaccgcggggcccacgccggtcgctgtctcctctcccttcctcctccgccgcatcatttcttcttcccctcgcttcgaagccaaacccgagctccggggaaaccactagtagccacttgagcttcttcttcgccactgaggggaaggggaagagggatcggaggagatggcgagcaacggcggcgaggagaagagccgggtggcggcggggtacggcgggggagggtacgggtacggcgggtacgaggggcgggacgacaggaagtggtggccgtggctcgtgcccaccgtgattgtcgcctgcatcgcggtgttcatcgtcgagatgtacgtcaacaactgccccaagcacggcagcgcgctcggcggctgcgtcgccggcttcctccgccgcttctccttccagccgctccgcgagaacccgctcctcggcccgtcttccgccactttgcagaaaatgggagctcttgactggaacaaagttgttcatcagcaccaaggatggcgtctcattagctgtatctggctccatgctggcctaatccatttggttgtgaacatgctgagtttactgtttattggaatccgccttgaacagcaatttgggttcgttcgcattggtgccatatacctgctatctggttttggcgggagtgtgttgtctgcgcttttccttcgtaataactacatctctgttggagcctctggagctttatttggactgcttggatcaatgctttctgagcttattatgaactggactatttattccaacaaggcagcagccataataactcttctatttataatcgcaatcaacttggctattgggatactacctcatgccgataactttgctcatatcggtggatttgtgacgggcttccttttgggatttgttttgttggcaaggccacagtttggttggatggaacgacatgagttgccccaaactaatcagcctcccaaatacaaagcataccaatatgttttgtgggttgtggcattcgttttgctgcttgtcgggtttgtggtttcactagtgatgctcttcaagggtaagaatggaaatgacggatgccactggtgccactacctgaactgcgtacccacatcgaagtggaagtgcaatacctaaggagtttagttttctgttgaattttcggcaaaaaaaaaaaaccgtagtattcagaggaccattttatgcttgtgtgtttgtagatatatgaacaaatttgtttatcatgtttgttctttactgtatcgcgatttgttcttcctgtaaatttgttccgtcggccactgaagtttatataggttgagcattctagttatttttatgctttcccgttacttcttgcttcaaatgccttcattgcagaaaagttgttctatgc

SEQ ID NO: 72 - DNA, 1179 bp, Oryza sativa
gagactcaactagagcaaataactcatatccgtagagcaaataactcatattcctagagtttatcattggtgtaagcttcaataggttagtgcgcttggcgaattcacaggccctatcttgtggtatgaactgggtacgcgatgatttgcactgcgtattgggggcttaccataagataatgccatgaatttgtcaagcgttcaaacccactgaaatgttgtgtgaaggtaaatatttcaaagtgttcatgaagaaaaggcaggtaaatatttcgttacttccccgtgacatgctaagccagaaacaatctcgctgcatgtgatatgctcagccagaaacagaaacaaaagagaaaaagagagtttcttcccagcttttttcatgtgttgtctggttagagcctactcgttgagtgcctataaaaggaacgttacgaacgaaagaagcagactcaagaatagtatatcattggtgtaagcttcaataggttagtgtactttgcgaattcacaggccctatattgtggtatgaactgagtacgcgatgatttatggtgcatattgggggcttaccataagataatgccatgaattcgcaaagtgttcaaacccactaaagtgttatgtaaaggtaaatatttgtaagtattcgggatggaaaggcaggtaaatatttaaagtttattaatttagaaatgtagctgagacattagaaagttttaacacacaacattacatattagtttgaatgagcaaaatataaaagcgttctactcattagcctcatcatcgaaatttcgtgacgtgttagtgtcctttttctttccctttcttctagcaccggttggaggtctgcatcctgacaaagataatcttttaggtgaatgtcgctcgcggacagacctacggaccacctcaacaccgctgagatcaacgtggccgtagttttgggtcgctgagttactggtggcgattcatcaagctgtgacggtcctatctcgtgttgtgctgttgacgaccccccaccgtagctatatggttctccgtaggactatgtgctgccagcatatcccatcatttgttcagggttgtacattcctacaaaacattgaatgcaaagttgtagcgtacacacataatggaaataaaatattttgtagtaaattataatttgtacct

SEQ ID NO: 73 - DNA, 1831 bp, Oryza sativa
tccctccaagtccaagtgaccaaccatcatcaatcatcgctaagcccacctcggagatctcgagttcgatcgtcgtcgtcgtagctgtagaggtagttaattatctcgttttagatgagctcactgacggcggcgcagttccggtcgctgtttgagatggcaggaggggaggatatctcgtttctgtttggtgatgatgaggcggcggcggtggcggcgccggtggagttgcaggggaagagggggtgggaggaggtggatcaaggggaggggtctggggcggtggcggcgaagaggcagcggtcgccgacgagctcgagggagaatagtagcgggagtaatgagggtgggcaggaggaggtgtctgaggcggcggcggccatggcggcggcggtggggaggggtggggggaggaggctgtgggtgaaggagagggactcggagtggtgggacatggtgagtagcccggattacccggactcggagttcaggaaggcgttccgcatgtccaaggccacgttcgaggtggtctgcgacgagctcgccgccgccgtcgccaaggaggacaccatgctccgcgccgccatcccggtgcgcaagcgcgtcgccgtctgcgtctggcgcctcgccacgggggagcccctgaggctggtgtccaagcgcttcggcctcgggatctccacctgccacaagctcgtgctcgaggtctgcgccgcgctcaaggccatggtgatgcccaaggtggtgcgctggcccgaggccggcgacgcggcggccatcgccgcgcacttcgaggccatctccgggatctccggcgtcgtcggcgcgatctacaccacccacatccccatcatcgcgcccaagtccaacgtcgcctcctactacaaccgccgccacacggagcgcaaccagaagacctcctactccatgaccgtccagtgcgtcgtcgactccaccggcgccttcaccgacgtctgcatcggctggccggggtccaactccgacgaggaggtgctcgagaagtcggcgctgtacctgcaccgcggcgttcccggcctgatccagggccagtgggtggtcggcggcgggagcttcccgctcatggactggatgctcgtgccctacacccaccagaacctgacgtgggcgcagcacatgctcaacgagaaggtcgccgccgtgcgcggcgtggcgcgcgacgcgttcgagcgcctcaagcgccggtggggctgcctccagaagcgcaccgaggtgaagctgctcgacctccccaccgtgctcggcgcctgctgcgtcctccacaacatctgcgagcgcagcggcgacgccgtcgtcgacgccgacgactgcgccttcgacctcttcgacgacgacatggtcgccgagaacgccgtccgctccaccgccgccgcgcaggcccgcgacgccatcgcccacaacctcctccacagcggcggcggcgcatccttcttctgatcaagcatcatcgccgttcttggtccgatcaacagcgataccaaacaaaccaacaaaaataaaaaagaaaaacaagattcagtttttaggtgtataggaggagcttctccattttttgtcggaaatggagcagtgaacagtttttcgctttatcgtcaggagggacaggaaagttcagagtcctagtagtctcaaagtaacattagtttcttggttggattttcgattgatttggttcttttagatcttgagagattgtttttcatggggttgtaattaattgcctgcataatcttgtatcccccagattatcaattaatcaaacctgaaaaagaaaatcatttttttgccaacc

SEQ ID NO: 74 - DNA, 913 bp, Zea mays
ctccaaaccctagcccagagcagccgcatcgaactctacctgcctttctctcgtccctggcggcggcggcaggatggcggcttctactgcgaggacggtgaaggatgtgaacccccacgagtttgtcaaggcctactccgcccatctcaaacgctccggcaagatggagcttcctgagtgggttgacattgtgaagactgcgaggttcaaggagctccctccttatgaccctgactggtactacatcagggctgcatctgtagcaaggaagatctacttgagacaaggcattggtgttggtggcttccagaagatttatggtggccgccagaggaatggctcacgcccacctcacttctgcaagagcagtggtgccatttcacgcaacatcctccagcagctgcaggagatgggcatcattgatgtcgatcccaagggtggacggcgcatcacctcccagggaaggcgtgatctggaccaggtggctggaagggttgctgttgaagcttgagcaatctcatatttggtttctatgatgtcatgtttgattgttgagatggctacactttatttgcactttggattaggatttttgtgttaagagaactcaaggcattctagctatggttcacactgtattttccctgagtacctatttatcaaaacctattcgtatgtttgggaagtgtctgagctgatattcatgacatgtatttggtataggtctatctatgtgacgtgataatatcattggatagattacgatctagatgaatttctatctcttgagtttcctaaactgtgcttgtttcgcttgcagtcagttagtctgctgtgattgaaccataggttcaacttagactggctgggctcgtcagcaacattattattacaatacgagagaatgctcaaa

SEQ ID NO: 75 - DNA, 2009 bp, Arabidopsis thaliana
cataaaactcaaaaatctttggtcttcaaacttcaaacacttgagaaaaaagcttttgatttcacatcttaatctaacaagtcaaacacttttcaaaccacaaaattcgtcaaagctctgaaacaaataaacattttttaatttctccctttttaatggaaatctcttctttcccatttccatacctacaagacgacgagtgttcccatttccttggtctatttcaagacatggactcttctccttctactttcggattagaaggttttaatagcaacgacaataatactaatcaaaagaaacgcccaagaaaagacgacgaaggcggtggtggtggcggcggaggaacagaagttctaggagctgttaatggtaataataaggctgcttttggagatatactcgcgacgcttctgttgttagacgaggaagctaaacagcaacaagaacagtgggattttgaatttattaaagagaagtctttacttgaagctaatcataagaagaaagtgaaaacaatggatggttattacaatcaaatgcaagatcattactctgcagctggtgaaaccgatggttcgcgttcaaaacgcgcacggaaaaccgcggttgcggctgtggtttccgcggtagcttccggggcggacacaaccggtttagctgctccggttccgaccgcggatatcgctagcggttccgggtcaggaccgagtcataggaggttatgggttaaagaacgaaccacggactggtgggacagagtaagccggcctgattttccagaagacgagtttcggcgagagttccgtatgagcaaatcgacgtttaacctaatatgcgaggagctagatacgacggtgacgaagaaaaacacgatgttaagagacgcgattccagctccaaaacgcgtaggcgtttgcgtttggcgtttggcgacaggagctccgcttcgccacgtgtcggagcgtttcggtctgggaatctcaacttgccacaaactagtcatcgaagtctgccgcgcgatctacgacgttctcatgcccaagtatctcctctggccgtcggattcagagataaactcaacgaaagccaaattcgaatcggtccacaaaataccaaacgtcgtcggatcaatctacaccacacatattccgatcatcgctccgaaagtccacgtggcggcgtattttaacaagagacacacggagaggaatcagaagacgtcgtactcgataacagtacaaggagtggtcaacgccgacgggatcttcaccgacgtttgtatcggaaacccaggatctctcaccgacgatcagatcctggagaaatcttcgctttcacggcaaagagcggcgcgtgggatgttacgtgacagctggatagttggaaactctgggtttccgttgactgattatcttcttgtaccgtacacgagacagaatctgacgtggacgcagcacgcgtttaacgagagtatcggagagattcaggggattgcgacggctgcgtttgagaggctcaaaggacggtgggcttgtttgcagaaacggacggaggtgaagcttcaggatctgccgtacgtgcttggagcttgttgtgtgttgcataacatttgtgagatgaggaaggaggagatgttgccggagttgaagtttgaggtttttgatgatgtggcggtgccggagaataatatccgatctgctagtgcggttaatacgagggatcatatctctcacaatctcttgcatcgtggacttgccgggacaagaactctataggctctgtttttcaccttttcttattttgaaactgattttttattgcaaattctttttccaaattaggaataaaaacattttagggattggttggatacagaaagaatagttgaattgagagtagaagtggctgatgatattgtttgtgttacttattagcattgtgtaatctttagttcatgtattttctatacaaattgaatctgaaacctcttaagtataagcttcttc

SEQ ID NO: 76 - DNA, 906 bp, Arabidopsis thaliana
catatctccaacatctcctccaaaacattcttttccttgtgattcattattttgcctagttttacttttcaaatagacttctaacaaaagttatgactgaaaaccaattatatagctttataaccatgaagagttcattgtctaaatgcaaacagtcttcttctttgtctttccctttgtttggtctgatcaacttcttcctcatcggttttttcagatgggtttcttttgctcagttatttttctctaggttctggcctcttgttcaacaccagcaatgtgtttccgagaagaagagcaaagatcttgagttccaaacttcgatcaaacacgaagaatatcgtgatgatgatgatgatggtctttgcagagaagatgtagggatggttatgaaaagcttagggctttccactgaccaagaaaacgagggacttcaaaaacagtacagttccaaggaggtttcgaatctgttcgaagagaaagagccaagcttagaggaagtgaagcaagcttttgatgtctttgatgaaaacagagatgggtttatcgatcctatagatttgcagagagttttgacaatccttggcttaaagcaaggatctaaccttgagaactgcaggagaatgatcagatcattcgatggaagtaaagacggaagaatcgatttctatggatttgtgaaattcatggagaacaacttctgctgaaatcgtatttccttaaagtatcaatttctgcacttcttttcttcttgctttgagattgtgtctgttaatactgttgtctccgcaccttgtataaactaccaaactttcatatcaaaagctctgctatagagcgtaaaaaccaatgagtttggaaataattgtcacagacatgaataatctgccaaaaggtgttattata

SEQ ID NO: 77 - DNA, 1945 bp, Arabidopsis thaliana
taatcctaaaacttcttttgagtgtgttgaagaagaagaagattaaaattcactaaaaacccgagaaaagtggaagaagaaggaaggaagaagaagacaagagagcattctgattcatgtgactctggtttcgtttctttctgtgtctctgctgtgtcgttttctcggcatatttctgatctttcgttctcggttggtttttggtttctgggtattgattgattgattcaaaagtcttcaactttcctggaaactggatctgggtttatccgtttttactcgtctgagaagagaaaaaaggatgaatccttatgatgcgaaagacagaagatggattctctctatgttcttcttcgtcgttttgttctgcaacaacgtttcgacttcgtcttcttcatctgaagttatcacgattaagccaagacatttatccttgctaaagagtgctttacaacggtcaagtggagaacagtctgatctatggaggccattgactgatcaaggatggagtccttgtattgatttgggaaattctccttcattaccggataaaaccgcgggatatgttcaggtatttcttgatggaggacttaaccagcaacgaatgggaatatgtgatgctgttgcagttgcgaagattttaaacgcaacactcgtgatcccttatcttgaagtgaatcctgtgtggcaagattcaagttcttttgttgatatttttgatgtcgatcattttatcgattctttaaaagatgacataagggtggttagagaactacctgatgaatactcttggagtacaagagagtattacggtacagcagtacgtgaaacacgagtgaaaaccgcgcctgttcatgcctctgcgaattggtatattgagaacgtctcaccagttctacaaagttatgggattgctgccatttctccattctctcaccggctatcattcgaccacttacctgctgagatccaacgactaagatgcaaagtgaatttccaagctttacgttttgtccctcacattacatcactcggtgatgctcttgtcagccgccttagaaacccgtcatggagaagcaataaggaacagaaaaatgttgatcatttaggagacatgaccaacccacacagaagacaagaacccgggaagtttgctgtgcttcatcttcgcttcgacaaggacatggctgcgcattcagcgtgtgattttggcggaggcaaagccgagaaactctccttggcgaaatacagacaaatgatttggcaaggaagagtgttgaattctcaattcactgatgaagagttaagaagtcaaggacggtgtcctctaacaccagaagaaatgggacttcttttagctgctttcggattcgataacaatactcgtctctatcttgcatcccacaaggtgtatggaggagaagctagaatctcaacattaagacaagtattcccaagaatggaagacaaaagaagtcttgcatcttctgaagaacgagctcgaatcaagggcaaagcttctttattagctgcacttgactactacgttagtatgcacagcgacattttcatctccgcatcacctggaaacatgcacaacgctcttgttggtcatcgaacattcgagaatctcaagacgatcagaccaaacatggcgttaataggacagcttttcctcaacaaaagcatcacttgggtagattttcagcaagcgcttggtgaaggacatgtgaatagacaaggacagatccggttaaggaaaccaaaacagtcgatttatacttatcctgctcctgattgtatgtgccatgtttgattagtttttaaagtcttgatctttagatatttcttataagaataaaaataaaaactctgattcttgatgaggctagtttgtgtttagatttgtgttcttgaggcttaataaaaagagtatagtttgatt

SEQ ID NO: 78 - DNA, 4829 bp, Arabidopsis thaliana
atcaacaaagttttattcccagaaagaaaaaagaaaaagatcattcatcagagttaagtcaatcaccaaaccatgatgaagaagaagaaacagagcagatcccagtcttcttctaccaagaaaacttttgaaccatcctcagattcttcaccttcacctaggctcctctccattatccgttctaagttggcaagtagtaaagacttgaagcatatgttcagaggtatgaggagtagaaccgtgcccggattatcttctcaatctagaatcgtgagatgtcctaagtgccacaaacttctccaggaacctttagatgctacttcttacaaatgtggtggatgcgactcgattcttcatgcaaaacgttgggaacctgacggcaatgatcacacaaacactattcctgaggctctcctttcttctcaaaaccgtagtttaagtgctgaggtagaatctccagaagatggtagtagaactccaatgagaactactcaccgggagtacaattcaaggccatcgacttctgttgaaagaggttatcatccagaaactgtttacaagcctgagacatctgatatccgcagagaatggatgagaaggactgatgacttcagtgagaccggtgattctgatgtgtttacttcagaaagaagctctccatataacacacgcagcaatgctgcgcaatgggcacaacatgagggaagatacgcagatccacctcgggttcctttctatccagcaagtccttccccttcttctgcatatgaatatggctacagtagtccttttcacgggtcttacgtttctgcatcagagcagtcttattatcatcaacaaccaaaccaattcgagcagtatagcagagaaggctggtttcaagaatcttctgttgcttcacctactcgttttccgggtgagacatctgatggaaagtactatcacaggtcttctcagtctcagctacatgatcttcagtatcataatctttatgaaccaagtagatctgaaaccccgcatcactctgtgtactctgagcgtagttatgtaccagctgctgcgccacaccgctctacatactctgagcattctgtagggatttctaagagtgacacaagtagtgaaaagagcattctaaggaacaaaaaacggtatgtcagggaaaggaatccggtagtgaagcgccatattctcccttcagccggcggtgcaccttttgcaacttgttcctattgcttggaacttctacagcttcctcaagtgtctccccaaggaaaacgtcaaagatatcaagtgagatgtggcagttgttccggtgtacttaagttctctattcgagagaaagcagatactgtcctggattcacctagctttgtggattatggcatggattttgcagatgagactgttactaatcaccaggattcagcatcagaaggtcatgaagagattaatcctgatggaagtcatctgacgtgtttagacgacgattctggagaaacaatctgcaaaagtaacgatgctgttatattgagtcaaaaaattctagaaacatttgaggataaagggattaaagaagacataaggaatatatccaccaaatttttagatttgaaattggaggcattacagcctcatctaaaacctatggggaaccgcagattaagcgagcaacaacctacatcaagtgagactattggagagacttccaagattcatctagagcaatctcaggaagctcattcagaaaagtcaaccgagatggataataacatttgtgatatagaagagcctgaatatgagaagaacgaaattattaagccagaagaaattgtaggagaaggatcaggtgagtccttggaagttccagtaaaccagaacgaaaggatgagtgaatcaagtgaagaagatgagagagttgcagagagatcggtatctcatagtgaggaacttctatacaagaaagaatacgtcagtgaaacacgtgtacagtctgagaataccggagacacttacgagtttgaatgggaggagactcaagaaactgaagaatatgaaggtgaaagtacattagaagagatcggagacaaaccgcagttgcatttggataaatctaggtacactcgagattctatatgtgacagcagcttaagctatggtgaaccatttgaggatacatcagtcaaggaagatacggagcacatatcaaacacaatttcagatgcgaagtcagctacaacacattctcccttgaactctttggtgaatgagaatcagaggtttataggacatcttgaccaatcaggcgaggctacagtaacaatatccaggatccaggagcactccaagtatgaatatgagaatttaagcgaaagacaagagttggaaatgaccattagtgacagagtcacgtgtaagttagaggagtctagatacgagacaaatgaaactcttgagccgagcaaggtgggcgaagatggatctcttgtttctttcgagaaggtgagcgaggcattcgaaacaatcatagaaggcaagacaggtgaagagagactggtatctcatcaaatggattctccaaacgagaatgtagaaaattcttatggaacattagaaccggtttatctagaagaaagcgggtttgcaggtgaaagaacatgggaagggacaatagaagatagagcggggttacatttggaggaatatgaaagcaactatgagaattacagcagaccatttgaatggacttcagaaacagctccaacatttcgcatgcatgattatgagctagggacaatacttgaaccagacgagtatgctgacggaagatcagaatcaagttcacggggctccttcaatgacgatggaggttcagaagagagggtcgtttttcatgagtctcaagttgctatacctgagcagtcccactatgagtatgagaactcaagcaaaagacaagagttgagtgacaccgtttttgacatagcaaggtctgaattacaagagtatagatatgagagaaatgaaacacttgagccaagtaagatggttggagatggatctgttgttcctgttgagaaggcgggtgaaactttcataagcaaaaagaatgaagacagctcggtatctcatcaaatggagtctcaaaatgaagatatggaaaattcctacggaacaaaagaaccggtttatccggaaggaagcagatgtgaaagtgaaaattcatgggcagagacaatgggagatggagcggggttgaagttagaggaatataatagcaatccatttgaatggacttctgaaaaagctgcagcatttcatctgcatgagtatgaacgatggacagtgcctgaaccagaagaggatgctaatgaaagatcaataaccagttcacgggattcctttaatgaccatgaaaatttaaaagggatagctgtgtctcatgaggaggagccctggctagtggatgagaacagaacggaagctctaaaagttggtgtaatggtggaagatgaaccatcgctgcacctgacgaaatttgaaaacgaaacaatgaaattggaagagacacttgaatggacttcagaaagagctccaacatttcgtctacctgagtatgagctaggggaaatgcttgaatcagacaacgacgttgatgaaagatcagaatatagttcaaagggttccttcaatgatcatgaaattccaagagagttgttaaatgaggaggatccccagctggtgattgatggcagaaccgaagctgtacaagtaggcgaaatggcaaaagatacagtatcactgcacttggaggaatgcggaaatgaatcaatgaaactggatgagacatttgaatggacgtcagggagaactttaacgtttcgtcgccatgggtatgaggtagagacaaagcttgaagcagacgaggatgctgatggaagatcagaatctagttcaaggggttccttcaatgatcgtggaagttcaaaagagagagctgtacttcacgaggatgggtcttggctggtggatgattatgaaaccaaagcgctaaaagtaggcgtaatggcagaagatggatcatcgctgcagttggagaaaggcgaaaatggaaaaatggatttggacgagacacttgaaccaagggatgatatattcaggctcagtcttgatgacacacttgagcaagaaaggatgacgtttcatttaaagatgtctcaagataagcaagaaagtctaaggcagacctttaaacaaggtgatgctgaaaaagattcagacgtattttcagaaggccatgaatttccaagtaaaatggcagaactagatagtgacactgaagaggagatagtggaagaacaattagaacatttgcagaaagagaatgagaagttaagtctaacctttgaacaacatgatcacatctacagcacaacggagccttctgaaattgtgggtttgcgtcatgcgttataccaaacgcaaaattcacctctacgatcacctctcacttcaccaattcatactcccattggttctccgctgcattacctgatggcttcacaaatacgttctccaatagcttcaacaatgcatagtcacatagtttcaccgcttcgttctcccatcaactcctctggatcactctctgatgtattgttcttcagcaagaaaacttgatggcacgaaaacagataagcattgttccaagctttccccacatacttgaagactttacctgcgatacaaaaacagtgtgtacattgtttcaattttgtttttgagtgattgtaaggttttctacagataataaatcaattcattgagta

SEQ ID NO: 79 - DNA, 602 bp, Ricinus communis
gtgcccgggaaaaagcaaaaagaaaaagaaaaaaaagagagaaaatcttggtccaacactatatcatggctactatcactgttaagttgattagctttcttgttttatgcttggtggttgctatgcccatgaccaccgaagccataacatgtggtcaagtcgttagcggcctgagctcatgcctttcctacctaaggagtggaggagcagtgccaccagcatgctgcaatggggttaggggtctcaatagcgctgctaaaaccacggccgatcgccaacaggtttgcgagtgcctgaaatctgcagctgccggaatcaaccttagtaatgcatctagcctccctggaaaatgtaacgttaacattccttacaagatcagcccatccactgactgcaagagcatcaagtgaggtggagatgatatacgcacaaaacagtacctagctatgcagttcgagaataataagaaggacttgtctgatctccagttgagagagtctccttcccgtactaggttaatctctacggtttattttctactactacgtttgatccttgtccttgtatgccagatataattaaaagagaggactttttattct

SEQ ID NO: 80 - DNA, 779 bp, Arabidopsis thaliana
atattcttagtacaaataagaaattcacacccctcaaagaaatataacataatcaatcataggaaatatacttcgcataatgacgataatgatcaagtttctcctgttagctctgctcgtgatctctccgatttgcgccgagaaggacctgatgaaagaggaatgccataatgcacaagttccgaccatttgcatgcaatgtcttgaatccgacccaacctccgttcatgcagaccgtgttggcatcgccgagatcatcatacactgtctcgactctcgtctcgatatcatcaccaataacattacaaatatattgtcactgggaggaggaacgaaagaagtgagaaaaatcttggaggattgcagaaatgacacgtcgacggtggcacctaaactactgtcggaagccaaaacaggtctgaaaaccggtgattacgacaaagccgccaaatcgatagagtatgctagcattcctcatagctgtggattaaagcaaccaagtgtcgagtttgagtttcttcaactgtttagtcaaatcagtatctatactcaactctctgatgctgccatgagaatcattgatcgcttctaattactccacctttttatctctatgtaactcaacaacatcgatgcttaccatgcatcccccatataaataaatgattccctcttttatcacgatttttattcatgcatggtctcatttaggcgacaattacttaacacttcaccatctaataatcatactaaactgatgttgtagaaattacgctcat

SEQ ID NO: 81 - DNA, 814 bp, Arabidopsis thaliana
aaaagcccaaaaatttactcggattttaaagcagattccttcgatctaaagaaagagagaaaatggagaatatgttaggtcttctaagacttcatgtgattagaggtgttaatcttgccatcagagattctcaaagcagtgatccttatgtcattgtccgtatgggaaaacagaagctacgaacccgtgtgatgaaaaagaatttgaatccagaatggaacgaagacttgacactttctgttactgatccaactcttcctgtcaagatcatggtgtacgatagggacaggttctcaagagatgataagatgggagatgcgatttttcacattgatccgttccttgaagccatcagaatccaaaaccaactaggaggactacctgaggggactgtaataatgaagatacaggcaagcagacaaaactgcttgtcagaagagagcaagattgtatggcacaaaggaaagattgtccagaacatgttccttaagcttcagaatgttgaacgaggggagatagagctgcagcttgagtggatcgatgtctccggcgccttgactgatgatgcggaggatgttgctttctagatcgactctatactacaagaaattcctgtgatgatacggcgaaaacaataacacaaactgatgtagtgatttactcaattaataatcttaatgcactagcgatcttatcgatgaagcaattaagagtagaaccacaaggactaattcacattaagaatgcacataattacttaacttaagaactaaatgttgcattgattcaataaaccggttgcaataatttattt

SEQ ID NO: 82 - DNA, 1415 bp, Arabidopsis thaliana
gagagattgaaagctttgttttgagttattttcaaagctaataaaaggagtgcttttatatttgatctaagtattcaaatctttaaagttgtggctaaacttcagtttgtgtttgcttttgtttatcaagattgttcttagactttttcgagttaaaaaacttgtgtgttggagtcatcatcgtgatcaatggaaaataaagttgagaaggagattacttgggtgattaaaaatttctcttctctgcaatctgcaacaatatattctgatatattcgttgttggtggctgcagatggtaagaagataaattgttttctaatatttttcgtctaatctacggtttacagataatattctttgattgctttcttttgtttttgcttgcaggcgttgtcaggccttccccaagggatataataaggctgattatctttctctgtatctcgacgttcctgataaagaatctttacctattggatgaagaagccacacaaaattttcttttactttagtaaataaaatttcggaaaaactctccaaacttaaagagactcagcagtggtttgataagaatgctcctgactgggggtttacagaaatgatcagcctcactgaacttcatgcggaagagggacttctgaggaacggagaactcaccgttgttgccaaggtagaggttcttgaagttgtaggaaaattagatgtatcagaggaatcttcaccagtaattgaaaccatagatgtcaatggatttcaagttcttccttcacaggtagaatatgcgaagtctttatttgaaagacatctagatattgcatcaaaattccgtccaaagaatccatacctaaagacggcgtacatgaatgtcctcttgagtttaacccaaacgatatgtcaatctcctcaagaactctccaatgatgatctctctgatgcaggcgctgcattggcatatttgagagaagcagggtttgagttggattggttggagaagaaacttaatgaagtaaaggaaaagaaaaagaaagaagaggcttgtttggccgagatacaagacatggacgaacatgttaagccattgaagaagaagtacttagacctggaagctcagatagataagaagaaggcagagttgctagctgcaagagctcctctctccttgaacgatgacaatgttgtctgattatttttgagttcttgggcacttggatttatgttttgcttgtgttttaatgttttatctctcgtgatgtgacaatgtcttgatttaggatttttctataatattgcggtgcagaactatcattactctccttctcctttaataaattgtggattagtgaaaaattgttatagagaatgaaaaaagaatgaaacgttatgtttgatgtttcaatattatgtcatataaata

SEQ ID NO: 83 - DNA, 1804 bp, Arabidopsis thaliana
ctttcagatactatcgttgacttcgaagtaagaaaagaaaatggagattttgacgagcatagctattacagtagcaacaacgatcttcatcgttttgtgtttcactatctatcttatgatcagaatctttaccgggaaatcaagaaacgacaagagatatgctccagtgcatgccacggtctttgatcttctcttccacagcgacgagttatacgattacgagacagagatcgcgagagagaagccgacttacaggtttttgagtccaggacagagcgagatattaactgcagatcctcgtaacgtggagcatattctcaagacaagattcgataactatagtaaaggacacagtagtagagagaatatggcggatcttctaggacatgggatctttgctgttgatggagagaaatggagacaacagaggaagctttcgagctttgagttctctactagagttttaagagattttagctgctctgtttttaggagaaatgcatctaagcttgttggttttgtctcggagtttgctctctctggaaaagcttttgatgctcaagatttgttgatgagatgtacactggactccatctttaaagttgggtttggtgtggagttaaaatgtttggatgggtttagcaaagaagggcaagagtttatggaagcttttgatgaaggtaacgttgcaactagttccagattcatcgatcctctttggaagctgaaatggtttttcaacattggatcacaatctaagctcaagaagagcattgctactatagataaatttgtctatagtctcattaccactaaaaggaaagagcttgctaaggaacagaacactgttgttagagaggacatactatcgagattcctagtggagagtgagaaagatccggagaacatgaatgataagtacctgagggatataattctgaacttcatgattgctggtaaggacacaaccgctgcactactctcttggttcttgtacatgctctgcaaaaacccacttgttcaggagaaaatcgtacaagaaatcagagatgtgacatttagtcacgagaaaacgaccgatgtaaatggtttcgttgaaagtattaacgaagaggctcttgatgagatgcactacctccatgcagccttgtctgagaccttgaggctctaccctcctgtgcctgtggacatgaggtgtgcagaaaatgatgacgttcttccagatggacatagagtgagcaaaggggataatatctactacatagcctatgcaatgggtaggatgacttacatttggggtcaagatgctgaagaattcaagccagagagatggctcaaggacggcttattccaacccgaatcaccattcaaattcataagctttcatgctggtccaagaatctgtcttggcaaggatttcgcataccggcagatgaagatagtatcaatggcacttcttcacttctttcgcttcaaaatggctgatgagaacagcaaggtgtattacaagagaatgcttactcttcatgtcgatggaggactccatctctgtgcaatcccgaggacaagcacttgagtacttaaccagaatactttccatacttttatagtgcctccatgagttttggtaacattctcaataaaggtggaacaagacaccaataacgttccatgtaataaataatctgcctttatagatcttgggatgactcaactatcacatatattagaatccgatgaacacgacacgatattgtataattttacagtcacctagtacaataaagcagataagtcgcactgt

SEQ ID NO: 84 - DNA, 396 bp, Arabidopsis thaliana
acaacatcttttttgaatagattttatagctgatacaacgagcaagagaaaatggccatcacaaagacttcagtgactcttttacttttaataataatggctgcttcgttgtctaatttcagcgtcttggcttcagagatcaaacctacaggaagagttgataatcaatgcaaggagatgtgttcggcaacgtttggggacggtaaatgtgccgcagactgtaggaaggctggtttctcatccggacgatgtcttacttcttctcctttcggaaataaatgttgttgcacctagtgatagctagaaccaatctatatgactatatgagttttctcttgttgtattgccacatattataattgtactgcaatagaataaaataattttattgttata

SEQ ID NO: 85 - DNA, 2450 bp, Arabidopsis thaliana
aaactctaatgtatctgaactcagaagatccgatcggagtagtaaaaattcaacaaaacaacaataagaaaactcattaattcattcgtcggattcgaagaagaaatcacttcccagaaactttcttcgtatcgaagtattgcttgtgttcttcggagaaacgagatcgggatccgaatacgagtacaatggaggtttcgcaagatggatcggaaagagataaaactcctcctccttcctcttcttcttcttcttcctctcccattcctgtcgtcaccaatttctggaaagaatttgatttggagaaggagaaaagcctgcttgacgagcaagggcttagaatagctgaaaatcaagaaaacagccaaaagaatcgccgaaagcttgcagagagcacacgagacttcaagaaagcttcgcctgagaacaaacttagtatgtttaattccctcctcaagggatatcaagaagaagtagataatattaccaagagggccaagtttggggagaatgctttcctaaatatctatcagaaactctatgaagcacctgatccgtttcctgctcttgcttctattgctgagcaagatcgtaaattatctgaagtggaatctgaaaatcgaaagatgaaagttgaacttgaggagtttaggacagaagcgactcatcttaaaaatcagcaggccacaataagaaggcttgaagaacggaaccgccagcttgagcaacagatggaagaaaaaatcaaagaagttgttgagatcaagcaacgaaatctggctgaggaaaaccagaaaacgatggagcttttaaaggatagggagcaagctttgcaagatcagttaaggcaagcaaaagacagcgtctccactatgcaaaaattgcatgagttagcacagaaccaactttttgaactccgtgctcaatcagacgaagagaccgcggggaagcaatctgaagttagtctattgatggatgaagtggagcgtgctcagacccgactccttactcttgagagggaaaagggacatctgcgttctcagctgcaaacagctaatgaagatactgataacaagaaaagtgataatattgattcgaatagtatgctggagaactcgttaactgcaaaagagaagattatttcggagcttaatatggagattcacaatgttgagacagctttagctaatgagcgagaaagtcatgttgccgagataaagaaattgaattctttgctcaataaaaaggatactatcattgaagagatgaagaaagagcttcaagaaagaccatcagcaaaattagttgatgatttgcgcaaaaaagtgaaaattctgcaggctgtaggttacaattcaattgaggctgaagactgggatgctgctaccactggtgaagagatgagcaaaatggagtcgcttcttcttgataaaaacagaaaaatggaacatgaggtcactcagttaaaggttcaactttctgagaaagcttccttgcttgagaaggctgaagccaagggagaagaactgacagctaaggttaatgaacaacaaagactgatacaaaagttggaggatgatattttgaagggttacggttcaaaagagcgaaaaggtgctctatttgatgaatgggagttctcagaagcaggtgtggctgagcagtctgagcctatggatcagaaacatgttccatcagagcaagatcaaagctcaatgctaaaagttatctgcagccaaagagatcggttccgagcacgattacgggaaacagaagaggaaataaggcgattaaaagagaagataggttttctcacagacgaattggagaagaccaaagcagacaacgtcaaactctatgggaaaatccgttatgtccaagactataaccatgataaagttgtttcccgaggatcgaaaaagtatgtggaagatcttgaaagtggattcagctcggatgtcgaatcaaaatacaagaaaatttacgaagatgacatcaacccttttgcagcattctcgaaaaaggaaagagagcaacggatcaaagatttgggaatcagagatcggattacgctaagcagtgggcggttccttctaggaaacaaatacgcaaggacatttgctttcttctacacaataggattgcacgtccttgtcttcacttgtctctaccgtatgtctgcttacagttatctcagccatggagcagaggagactctaatgacagaagcaaccacaaaccttcctcacggtctttaagctctcaccctagggacttattcgtttttggtcgttatgttctttcttgtccttgtagtgttccgtgggcaattctaaaacggttgaatatttgtacagagggatccaaatcactcgatacatatataaagccacagaaaaaacttccttcagaaaactgcagaaatctaaataagatctggtttacttttc

SEQ ID NO: 86 - DNA, 1812 bp, Arabidopsis thaliana
gaaattacataattaccaaagaaaaaaatgatttttttttaggggttttaattagttagaaaaaaggaggctcctttggaagaacaagtattacaacagtcgtcgtcgtcaagcggcgtcagagaaagtctctctctgtgtctaactgaaaaaaatgcaatctggcggcgatttcagcaacggtttccacggagaccatcaccgcgagcttgaattggaagacaagcaaggccccagtctcagctcttttggccgagccaagaagcgcagtcacgccggagctcgtgaccctcgaggcggtctcgccaatgtgcttagggtttctgaccagcttggcgagcacaagtcattggagacttcggaatcttctcctccgccttgtactgacttcgacgttgcctattttcattcctatgctcacgttgggattcacgaagagatgatcaaggatcgggcaaggacagaaacttatagggaagccataatgcagcatcagagcttaatcgaaggcaaggtcgtggtggacgttggctgtggaactggcatcctttcaatcttctgtgctcaagcaggtgcaaaacgggtatatgctgtagatgcaagtgatattgctgtccaggcaaaggaagttgtgaaagccaacggtttatccgataaggtcattgtcttgcacgggagagtggaggatgttgaaatcgacgaggaggttgatgttataatttcagagtggatgggttacatgctcttgtatgagagcatgctgggaagtgttatcacagctagagatcgctggttgaagcctggaggtttaattctcccatcacatgcaacattatacatggcacctatttctcaccctgacagatacagtcacagtattgatttttggcgcaatgtttatggaattgatatgtctgcgatgatgcaattagctaaacagtgtgcttttgaagaacccagcgtggagtccatatcaggcgagaacgttctaacatggccagaagtggttaaacatatagactgtaaaactataaaaatccaagagctagactcggttactgcaagatataaattcaactcaatgatgagagctccaatgcatggttttgcattttggttcgacgttgaattcagcggaccggcctcttcacctgccaagaatactagtgaaaccagtattgctagtggttcttcgtcgataagtccttctggagaagtaaatcagaagaagcggactaatccgagtgatgcacttgtgttgtccacctctcccgagtctcctccaacgcattggcagcaaacgattgtatatttctatgaccctatagacgtagagcaagaccaagtcattgaaggttccgtgacactttctcaaagcaaagagaacaagagattcatgaacatccacctcgaatattcctcggccggccgttcctttgtaaaagagtcagtaatgcgttaaggaggcgattctctgacaattcatccttacctttagaagccctgtaaggtgtagtctcttctgctaaagcaattattagtccagaaattgcagaaccaacaattgaggacattgacaaactcaagctatttttagtctgcgaaaacaccagttcttgtaagattatttaggttttagatcagatggaagcaattttaggacattgttcttgaggctatttataagcttgttactagccatccactcagcagacacttctctttgagtgcttatatatgtcatgcatattttattggtgatttgtataaaattcatcatgatcaatttattcaatttagcgttttaaaatc

SEQ ID NO: 87 - DNA, 1663 bp, Arabidopsis thaliana
ttcactcaccaaaatagatctaaaacatggaaaccaaaaccctaattttctcaattctcttcgttgttctctctctcatttacttaattggaaaactcaagcgaaagccaaatctacctccgagtccggcatggtcattaccggtgattggtcatctccgccttctcaaaccaccgattcatcgcacattcctctccctctctcaatccctaaacaatgctccgatcttctccctccgactcggtaaccgactcgttttcgtgaactcgtcacactcgatcgccgaggaatgtttcaccaaaaacgacgtcgtactggcgaacagaccaaacttcatcctcgctaaacacgttgcgtacgattacacaaccatgatcgcagcttcctacggtgaccactggcgtaacctccgccgcatcggctccgtcgagatattctccaatcaccgtctcaatagctttttgtctattcgtaaagacgagatccgacgacttgtgtttcgtctttctcggaacttttcacaagagtttgtgaaagtggatatgaaatcaatgttatctgacttaacattcaacaacattttaagaatggtggccggaaaacgttactacggagacggtgttgaggatgatccggaggctaaacgtgtccggcagcttatagcggatgtggtggcttgtgctggtgctggaaacgctgttgattacttaccggttttgcggttggtttcagattacgagacacgggttaagaagttggcgggtaggctcgacgagttcttgcaaggattggttgatgagaaacgagaagctaaggagaaaggaaacactatgatcgatcacttgcttactctgcaagaatcccaaccggattacttcacggatcgtatcattaaaggaaacatgctcgctttgatactagcagggaccgacacatcagcggttacgttagaatgggcattgtcgaacgtgttgaaccatccggatgtattgaacaaggcgagagatgaaatcgatagaaagataggtttagacaggcttatggatgaatcagatatctcaaacctgccttatctccaaaacattgtgtctgaaacgttgcgcctttatcctgcggctcccatgcttcttcctcacgttgcctcggaagattgtaaagttgcaggatacgatatgccgcgtggcacgatactattgaccaatgtgtgggctatacacagagatcctcagctatgggatgatccaatgagcttcaagccagagaggtttgagaaagaaggagaagctcagaagctaatgccgtttgggttaggaagaagggcgtgtcctggttctggactggctcatcggcttataaacctgactcttggatcattgattcagtgtttggaatgggagaagattggagaagaagtggatatgagtgaaggcaaaggtgttacaatgcctaaagccaagcctttggaagccatgtgcagagcacgtccctctgttgttaaaatcttcaacgagtccgtttgacgtttagacttttggtaatggctatgtatacattagataactagttatgtttgtatgttttctttttttttggtgaaaatattatgtttgtatgttaatgtatatgtgaatatttaacctatattcctagatgatattttggg

SEQ ID NO: 88 - DNA, 1791 bp, Arabidopsis thaliana
cttcttgtttcggaagcgacgaacttctggtttcaaggaggctgttttccctgagagatgttcagattcttgagctctttattgcctttttcgtgtttgcgacaatacattccttgcgccagaagaaacaccaagggatgcccgtttggccgttggttggcatgcttccttcgttgatatccgcggtacgaagcaacatatacgaatggctgtctgatgttcttatcagccaaaacgggacattccggtttagaggtccttggtttagcaccctcaactgcgttgttacctgcgacccaagaaacgttgagcatcttctcaagacccgtttctctatctacccaaagggttcttacttccgtgagaccatgcaagatctactcggagacgggattttcaacaccgatgacggaacgtggcaacgacaaaggaaagcagcaagtgtcgaattccattcggctaaattcagacaattaaccagtcaatcattgcacgaactcgtgcataatcgacttttgccggttctagaaacttccggaaagattgatcttcaggacattttgttaagactaacgttcgacaatgtatgcatgattgctttcggggtcgatccaggctgtcttagtccaaaactacccgaaattccttttgcaaaagccttcgaggacgcaacagaagcaacagttgtgagatttgtgatgcctaaattcgtgtggaagctcatgaggtctcttaatttaggaacggagaagaagctaaaggaatcaataaatggtgtggatgatttcgctgaagaagtaatccggacgaggaagaaagagatgtctctagagactgaaatcgcgaagagacctgatctcttgactatttttatgggtctacgagacgaaaatggacagaaattttcagataagttcttgcgtgatatttgtgtgaacttcatacttgctgggagagacacttcctctgtggctctaagctggtttttctggttaatcgagaagaatccggaagtggaggagaaaattatgatgggaatttgcaagattcttgagcagagggttgatcatggagatacaaagaagaacatggaatatgagcccgtcttcagaccagaagagatcaagaaaatggattatctacaagctgctttgtctgagactcttagattgtatccctctgttccagtcgatcacaaagaggtacttgaagacgatgtatttccagatgggacgaaattaaaaaaaggagaaaaggttatatatgcaatatacgcgatgggacgtatggaaacaatttgggggaaagactgtcgtgagttcaagccagaaaggtggttaagagacggcaggtacatgagtgagtcggcctataagttcacggccttcaatggtggtcctcggctatgtctaggcaaggattttgcgtattaccaaatgagatatgtagcggccgccattatttaccggtataaggttagggttgatgataagggtggtcataaggttgagccaaagatggctctaactatgtacatgaagcatggcttgaaggtgaatatggtcaagaggagtgtctctgagatagaccactactactgctgagtgcctgacataaagggtataaaattggtgtatatatagtggttcgtgttttgagatttatgaattgtaacaggtgattgttttttggtgattttgatttggtagttaagtgggttcatataataattgtaacttgcgatatattgtattctacaaaagagtccatatttttgtcatttctcttata

SEQ ID NO: 89 - DNA, 1503 bp, Arabidopsis thaliana
aaagcttcaaatctatctctcacgaactcccaagctaacaacattcacaaggagagagaaacaataaagggcaaggaaaaagatcaaacctttttctttctttctttctcctgctctctgcaatttagaagaagatcgaagaatttgtttgttgtttatcttcttctataaaaacaaaccgtggggtctgttttcatttctggccttgcgattccgataaaactctcagcttcccattcaatccaatccaattccacttctcaaacatatatataattctatatttttgagagacagtttactttttctccttctctctctctctctctttctctttctctgtctctttggcttttctcctcctgttctcatggaagcttcacccaatgatcgacttcattttggcaaaatgggtttcgggtgtaagcattacaagaggagatgccaaatcagagctccatgttgcaacgaagtcttcgattgtcgccattgtcacaacgagagcactagcacattgcgcaatatctacgaccgtcacgatcttgttcgtcaagacgttaaacaagtgatttgttctgtttgcgatacagagcagccggcagctcaagtttgttcgaattgtggtgtcaacatgggagaatatttttgcagcatctgcatattctatgatgatgatactgaaaaacaacagtttcattgcgatgactgtggaatttgcagagttggtgggcgtgagaatttcttccattgcaagaagtgtggatcttgttatgcggttggtctgcgcaacaaccatcgctgcgttgagaattcaatgcgtcatcactgtcccatttgttacgagtacctttttgactctctaaaggacacaaatgtgatgaaatgcgggcacacaatgcacgtagaatgctacaacgagatgatcaaacgtgacaagttttgttgtccaatttgctcgaggtcagtgattgatatgtctaaaacatggcagagactcgatgaagagatcgaagccactgctatgccttcagattaccgtgacaagaaggtttggatactttgcaacgattgtaacgacacaacagaagtgcacttccacataatcggacagaaatgtggacattgcagatcatacaacacacgagcgattgcgcctcctgttcttcctcaatgacaaaaccaagatcttcccatgtattgcctccagaaagcaagcaagaactttttgttgctaaaaaaactgaggcatagattgatgatcataacaaagaaagaaaaagaaaaagattgatgatcaatttgatcattggtcacaaaagcaaaacacacatttgtcttcttcatttgatttgttgttgttcttatactgttacatttttccatttgtgtttgggtgttggaaatgcgaggattatgtataatatactctatattcttgatccaggaaaagttacctggataatatgttttcagggattttttagtagttcaattcttacatca

SEQ ID NO: 90 - DNA, 3428 bp, Arabidopsis thaliana
gggagggtgacgttgaaggagattttgtaatggattctgctattgaaattagttcaggtagtgatagtgatgacgaagtaccaccgcagcctgtttggccacaaactcgaaccaggatggatcccacatggctaagcaggagacctttgcctacagtggatagccatgctagagctgaacatacaaatcaggctcctcccaatggtgcctcgagtgatacttctcggcctggagtctctaagcctttcacagggaatgggaacactgtaaactcgagaatttccagtggatctggtgctgattatgtgagactgtcttctgagcaagctctgaaaagaactcttccaccctcttttaattcccctccccttcctgccagaagtggcactaacaatataagtaatgctagtggaagtcgtgttggtgtggattatgagagaccattgtctcagcaagctctgaaaagaactcttccaccctcttttaatccccctccccttccttccagaagtggcacaaacaatatacgtaatgctggtgggagtcgctttggtgccgattatagtcatccagctgtgtcagctgtaggcaacaagagtacctttggtgatcattatagtggagcccatgctgagataggaattcaacgtggcgtgaatggggttaggatcctgcctccatctctgacgcatggaacatctgcttctgttttgcatcatgctggttcgagtgatccaatgcacaggtttggtggtggtgaagataggaatcctgataacgatgaaaggctggtttatcaggctgcactacaggttttgaatcaacccatgactgaaagtgatctacctcctggtactctttcagttcctcttatgaggcatcagaaaattgcgttggcatggatgtttcagaaggaaacaagtagtttcaactgtccaggagggatactagcagatgatcagggacttggtaagacggtctcgacgattgctcttatcctaaagcaaaagattgtgtcacaactgaagtccgaaagttcatgcaagcaagaaactgaggcattagtcctggatgctgatgatgagtcagacaatgcaaagcatgaaagtggtagtcatgtaaaaccagagctcaaggtttcaagcaacagtgagacctcggttctgagtgcatgtggtaatgatgagaatgacagttcagatatggagaaagccgaagatgaagaagctaattcttcaacacgagcatttcagtggaagagaccagctgctggtacattaattgtttgcccagcgagtgttgtaaggcagtgggcaagagagcttgatgagaaggtttctgaagaatccaaactttctgtgttagtctaccatggtagtaataggaccaaagatcctaatgaattagcagaatacgatgtggttgtgacaacgtacgctattgttactaatgaagctcccaacaaattcttggtggatgaggatgagaacgatgaaaaaaatactgacagatatggtcttgcctctggcttctccaacaataagaaacggaaagtcgtggtgggtgctagtaagaagagtaaaagaagaggtagaaaaagcactaacgatacttcttctgagcctgattgtggtcctctaggaaaggttgggtggttcagaatagtactagatgaagctcagacaattaagaactatagaacacaaatggcaagatcatgttgcactcttcgagccaaaaggaggtggtgcttgtctggaacaccaatacaaaatacgattgatgatttatatagctatttcaggtttcttagatatgatccatatgcggtgtacaagtcattttacagtacaatcaaggttccaatttccagaaattcttgtcaaggttacaagaagcttcaagctgttctaagggctataatgctgcgccgcaccaaaggaacattgcttgatgggaaacccataattaatctacctccaaaggtagtaaatttgagccaggtagacttttcagtggctgagcgctctttctacaagaagcttgaagctgattcacgttcacagttcaaggcctatgctgatgcgggaactttgagtcaaaactacgcaaatattcttctgttgcttttgcgactacgccaagcttgtgaccacccacaacttgttaaaagatataactcagatcctgttggaaaagtatcagaagcagcagttagaagactccctagggaggctcgaagcagactgatcaatcgcttagagtcatcatctgccatctgctatgagtgcaatgagccaccagaaaaacctgttgttacgttgtgtggccatatattttgctatgaatgtgttttagaatacataactggggatgagaacacgtgccctgtaccgagatgcaaacaacagcttgcgcgtgatgttgttttctctgaatcttctcttagaaattgcacttctgatgattcgggctgtagttcctctcatgataatggtcttgatagatcggtatttcaaaaaagagacttttgttcatcaaaaattaaagctgtcctcgatatcctgcagtcgctttcccaaccagacagtccaaactcagctcagcatggtcaaatgccatcttcctcacggccatatgatgacgatgatgttaccattgtagagccaatgcgtcttcactcatcttcacctagccagggggcagtaaagacgataatattttctcagtggactggtatgcttgacttggttgagctgcgtattcttgaaagtggtattgaattcagaagattagatggcacaatgagtctagcagcaagagacagggcggttaaagaattcagtaaaaaaccagatgtaaaggtgatgctgatgtcgctaaaagctggaaaccttgggctgaatatggtagctgcatgtcatgttattctcttggatctttggtggaatccaactaccgaagatcaggcgattgatcgtgcacatcgtattggacaaactcggccagttactgtaactcgcataactataaaagacaccgttgaggatagaattttgaagcttcaggaagagaaaaggacaatggttgcatcggcctttggtgaagaacatggtggaagctctgcgacacgtctaacagtagacgatctcaagtatctgtttatggtgtagactactcgttgtatggtctaagcgtagccttctaatcgcctcttgaactaggttgcttagtacagtacatatgggagatttagcccagaattttgatcaggaagaaacctctagctgcttttgtaatggatatccaatactgtggcactcctttggttttgtaaggtttgaacccaatctatgcatttttggtgtttccaaagtgcatcgattggaaacaggccataagtaaataactaaaatcggttcatggta

SEQ ID NO: 91 - DNA, 5859 bp, Arabidopsis thaliana
ttgtggaggaggagagggtggtagtagtaattatagtttcgattcacggtggatatggaagctagttcgagtggaacggcggagttgccgcggtctctttctcggagagctccgtcgcgtgcgactactatgatgattgatagaccaaacgaagatgctagtgctatggatagcgagcttgttccttcctctctcgcttctattgccccgattcttcgcgttgctaatgaaattgagaaggacaatcctcgagtggcttatctatgccggtttcatgcgtttgagaaagctcataggatggatgctacatccagtggacgaggtgttcgtcagtttaagacctatctgttacatagacttgagaaggaagaagaggaaaccaagcctcagctggcgaaaaacgatcctagagaaattcaggcatattaccagaacttctatgagaaatatattaaagaaggagaaacatcaagaaaaccggaggaaatggcaaggctttaccaaattgcatcggtattgtacgatgtactgaagactgtagtaccttcacctaaagtggattacgagacccgtagatatgccgaagaagttgaaaggaaaagggatagatatgagcactacaacattcttcctttatatgctgtagggactaaaccagcaattgtggaacttcctgaggtcaaggctgcattcagtgctgtccgtaatgtgcgcaatcttccacgacgaagaattcatttgccatctaatacccctaatgaaatgcgtaaggctagaaccaaacttaatgacatacttgaatggcttgcttctgagttcgggtttcagagagggaacgtggcaaatcagagggagcacataatactgcttcttgctaatgctgacattagaaagagaaatgatgaagaatatgatgagttgaaacctagcaccgtcactgagttgatggacaaaacttttaaaagttattactcatggtgtaaatatttgcactctacgtctaatctcaagtttccagatgattgtgataaacagcagctgcagcttatctatatttccctgtaccttttaatatggggtgaagcctcgaatgttagatttatgcccgaatgtatctgctatattttccataatatggcaaatgacgtctatggaattctgtttagcaatgttgaagctgttagtggtgagacatatgaaacagaagaagttattgatgaagaatcatttctgagaactgttataactccaatctatcaggtcatacgcaacgaagccaaaaggaacaagggaggtacagcaagccattcgcaatggagaaattacgatgatttgaatgaatacttttggtctaagaaatgcttcaagataggatggcctcttgaccttaaagcagactttttcctaaactctgacgagataaccccacaggacgagaggctgaatcaagtcacttatgggaaaagcaagcctaaaaccaactttgttgaagtccgcacattctggaacctcttcagagattttgatcgaatgtggatatttcttgtcatggcttttcaggctatggtaatagttggatggcatggttctgggtcactaggtgacatatttgacaaggatgtattcaaaacggtgttaactatttttattacttcggcgtatctgactcttttacaagctgcactggatattatcctaaatttcaatgcctggaagaatttcaagttttcccagatattgcggtaccttttgaaattcgcagtagcatttatgtgggcggtactgcttccaattgcttactcgaagtctgttcaacgcccaactggagttgtaaagttcttcagtacttggactggggattggaaggatcagtccttttatacgtacgctgtttcattttatgtgttaccaaacatattggcagctctgttattcctcgttccaccattccggagagccatggagtgttcagacatgcgacctatcaaagttataatgtggtgggctcaggcaagtattaaactattcttctggttcttgagtatactgccaaaactatacgttggaagaggtatgcatgaggacatgttctctctcttcaagtataccaccttctggatcatgctactgatcagcaagcttgctttcaactattatgtggagatactaccccttattacgccaacaaagatgatcatgaatctgcacattggtcactaccagtggcatgaattttttccccatgcaactaacaatattggagtggttattgctatatgggctccaattgtactggtttacttgatggatactcaaatatggtacgccattttttccactctgtttggaggcatacatggggccttcagtcatctgggagaaatacggactcttgggatgttgcgatctagatttgagtcaataccaattgccttcagccgcaccctcatgccatccgaagatgcaaaaagaaaacatgcggatgactatgtggaccagaaaaacatcactaatttctcccaggtgtggaacgagttcatttactctatgagaagcgaggataagatcagtgacagagatagggatttgctgcttgtaccatcttcgtcgggtgatgtgtctgtcatccagtggccacctttcttgcttgctagtaagattcctattgctgtggacatggcaaaagatttcaagggaaaagaggatgctgaactatttagaaagattaagagtgatagctacatgtattatgctgttattgagagttatgagacattgaagaaaataatttacgctcttctggaagatgaagcagatagaagggtcatgaatcaggtatttttagaagtggacatgagcatgcagcaacagagattcatatatgaattccgcatgagtggattaccgctccttagtgataagctggagaagtttctaagtatattgttaagtgactatgaagaccagggtacatacaagtctcagttaattaatgtcttccaggatgttatcgaaattatcactcaagatctcttggttaatgggcatgaaattcttgaaagggctcgtgttcattctcctgacatcaaaaatgagaaaaaggaacagaggtttgagaaaattaatatccacctagtacgggatagatgttggcgggaaaaggttattcggcttcatttgctcttatcggtcaaagaatctgcaataaatgttcctcaaaacttggaagcccgccgacgtatcacattctttgctaattctctgtttatgaatatgcctagtgctccaagaatacgagatatgctatctttcagtgttttaactccttactacaaagaagatgtgctgtattcagaggaagaccttaacaaggaaaatgaagatgggatctcaattctgttttatctacaaaagatttatcctgatgagtggaccaattatttggatcgcttaaaggatcctaagcttcctgagaaagacaagtcagagttccttcgagagtgggtatcttacagaggtcagacgttagccagaacagttaggggtatgatgtactatagacaggctctggagcttcaatgctaccaggaagttgcaggggaacaagccgagtttagtgtctttcgggccatggcgtccaacgatgaaaatcagaaggctttcctggaacgtgccagagctcttgcagatctgaagttcacttatgttgtttcttgtcaggtctacggaaatcagaaaaagtccggtgatatccacaaccgcagctgctacacgaatattctgcagctcatgctaaaatatccatcattgcgggttgcttatgtagatgagagggaggagacagcagatgcaaaatctccgaaggtcttttactctgtacttctaaaaggaggtgacaagtttgatgaggaaatttaccgcatcaagcttcctggtcctccagctgagattggtgaaggaaagcctgaaaatcaaaatcatgctatcatatttacacgtggtgaagcactacaaactatagatatgaatcaagacaattactttgaagaagctttcaaactaagaaatgtattggaggaattcaataaggagcgtgttggtagacgcaagccaacaatattgggtctccgagaacatatatttactggaagtgtttcgtcattagcttggttcatgtccaatcaggagagtagttttgtgacaattggccaaagaattttggcaaaccctctgagggtccgttttcattatggtcatcctgacatatttgacagaatctttcacataacaaggggcggtgtgagcaaggcttcgaaagtaataaatttgagtgaggatattttcggaggcttcaattcaactctccgtggaggatatgttacacatcacgagtatatccaagttggaaagggacgggacgtggggttgaacccaatctctatttttgaagcaaaagtagcaaatggaaacggggagcaaacgctaagccgtgatgtttaccgtttggggcatcggtttgacttttacaggatgctctcattctattttacgaccattggattctattttagtagcatgctcaccgttcttactgtatatgcattcctgtatggacggatgtacatggttatgagcggattggagaaagagattttgagactcgcaagcccgaatcagcttgaggctcttgagcaggctctggctacacagtcaatatttcagcttggtttcttgatggtgttaccgatggtaatggagattggcttggaacacggttttcgctctgctattgtcgattttttcataatgcagctgcagctagcctcggtattctttacattccagcttgggacaaagtcacattattacgggagaacaattttacatggtggttccaaatatagaccgacgggccgtgggtttgttgttttccatgccaagtttgcggagaactacaggttgtattcgagaagtcactttgtgaagggactagagctgcttttattgctagttgtttatcaaatctatgggcattcataccggagttcaaacctttatctgtatatcacagtctcgatgtggtttatggttggttcttggttgtttgcaccatttatattcaatccttcggggtttgagtggcaaaagacagttgacgattggactgattggaaacgatggcttggagatcggggtggtataggcatcccggttgaaaaaagctgggaatcgtggtggaacgtagagcaagaacacctcaaacatacaagtattagagggaggattctggaaatcacacttgctctccgctttttcatttatcagtacggaattgtttaccagctcaatatctctcagcgcagcaagagctttttggtttatggactctcttgggtggtcttgctcacatcattacttgttctaaagatggtatctatgggcagacgaagatttggaacagattttcagctaatgttcaggattcttaaagcacttctcttcctcggctttttgtcagtcatgacaatattatttgtggtgttcaaactcacactcaccgatctctctgcttcagttcttgcttttcttccaaccgggtgggcgattcttctgattgggcaagtactgaggtcaccgatcaaagctttaggggtttgggactcggtgaaagagctaggaagagcgtatgagaatatcatgggacttgtaatctttgcaccaatcgctgttctgtcttggtttcccattgtctccgagtttcaagctcgtctgcttttcaatcaagcttttagcagaggccttcaaatctctatgattctcgctggtcggaaagacaaagcaacttcttcgcacaagtaa

SEQ ID NO: 92 - DNA, 5366 bp, Arabidopsis thaliana
ggggctcttgttgtgttagagagagctcagatcagatgtggctttcttcttcttctccttcttcttccgcatagtgactctgagaaccagattattcaagaaaataccctttttgtttccttgttcgtttattgtggctcgtctctaacagcttcggtttaagagttctctgtttcactccccatggctcagaagccggaggaacagttgaaagagctgggatcgaagcttgacctagctcctgtttctaaagattcattgctcaaactcttaaaggaagctgctgtttgtctttctgagttggagcagtctccaccacctgcagtgctcaagtccattcagccttttcttgatgcagttattaaacctgaaattctcaaccatcaagacaaggatgtcaagcttcttgttgcaagctgcgtttctgagataactcgtattacagcacctgaagcgccttacagtgataatattatgaaggatatttttcaactaattgtgagcgcttttgctgggttgaatgatgtcagtggtccatcatttggaaggagggttctcattttagaaacggttgcaaagtacaggtcatgtgtagtgatgttggatcttgaatgtgatgatctggtgaaagaagtgtttactacatttcttgatgttgctagagatgaccatccggagattgttttctcatcaatgcaaaatataatgattgttcttttagaagaaagcgaagatgtgcaagagcaccttttactaattttactctctaaattgggccgcaatagaagtgacgttagagatgctgcaagaagacttgctatgaaagtcatagagcattgtgcgcccaaagttgaatctgacataaagcagttccttatctcttcaatgtctggagatagccgattttccagcagtcaaattgactaccatgaggttatctatgatttgtaccgctgtgctcctcaggccctatctggagttgcaccatatctcactggagagcttttggcggataaactggaaactcgtttgaaagtggttggattggttggagagttgttttccttgcctggacgtgtcatctctgaagagttcgattcaatttttttggagtttctgaaaaggctgaccgatagggtagttgaagttaggatggccatccttgaccatattaaggactgtttgctctcagatcctttgagagctgaggcttctcaaattatatctgctctctgtgaccggctcttggattatgatgagaatatccgcaaacaagttgttgctgttatttgtgatgtgtctgtgagtgcattgacgtcgattccagttgacactatgaagttagttgctgaacggcttcgtgacaaagctatactcgtaaaaacatacacaatggaaaggttgactgagttgttccgggtatattgcttacggtgtgctgatgggaaggtagacactggcgattttaattggattcctggaaaaatcttgagatgtctttatgacaaagatttcaggtcagatacaattgagtatattctatgcagttcactgtttcctagtgatttctcagtaagagataaagttaagcattggatacaaatcttttccgggtttgacaaagtggagaccaaagcttttgagaagatactggagcaaagacaaaggatacaacaagaaatgcaaagatatttgtcaatcaagcagacacaacagactgctgatgctcctgagattcagaaaaagatcctatttggattcagagttatgtcacgtgcattttctgaccccccaaagactgagcaaaactttttaattcttgatcaactgaaagatgctaatatctggaagattttgactaatctgcttgatcccaacactagcataacgcaagcatccaggattcgggatgatatgcttaaaatactctctgagaagcattctctctatgattttctcagcactctctccataaagtgttcttatctgctattcagtaaggagtatgtgaaagagatattagcggaagtatctgttagaaagtcttctaaaaatacattggggatccaaccttgcatggacttcttagggctcctggcatgtttctgtccatcattgtttgatggcgctgaagaagaactgataagtttccttaaagatgacgatgaaatgatgaaggagggtactctaaaaattctggcaaaagcaggtggaactattcgggagaatctcattgttttagcaagttctgtggaccttttactggagaggatttgtgtagaaggaaaccgcaagcaggctaagtatgctgtgcatgcgctagcatcaataacaaaggatgatggcctgaagtcgctctctgttctatacaagagacttgtggacatgctggaggacaagagatatcagccggctgttcttcagtgtcttggatgcatagcacagattgcgatgccagtctatgagactagagaaagcgaagtagttgagtttattagaagcaaaatcctaaagctcaaaagtgaaactgtggatgacaaaaaattgtcatgggatgacaaaagtgaaatttgtcaactgaagatatatgggatcaagacgttggttaagagctatttaccttttaaggatgctcaacttcgtgcgggtgttgatgatcttcttggaatactaaaaaacattctttcctttggcgaagtatccgaagatctagaatcaagttctgttgacaaggcccatttgagacttgctgctgcaaaggctgtcctccgcctttctagacattgggatgataagatacctattgagatcttccatttaactttaaaaacccctgagataccatttcctacagctaagaaaatattccttgggaaagttcaccagtatgtaaaggatcgggttttggagatgaagtatgcctgttcattcctatttgatatcactggatcaaatgttctcgaatcagaggaggataaacacaacctagctgatatcatacagcattcttatcaaacaaaagtgcggaaaatttcggctcagactgatgcaaattcagttactctctaccctcatcatatcctcccttatctggttcatgcacttgcgcatcattcttgtcctgatgtcgagaaatgcaaagacgtgaaggaatatgaaatgatatatcgccaattatacttgatcatttctatgttgctccataaagaggaagacgggaagactgaagatattgataaggaacgtgagtacgttcccaccattattcttatcttccatagtataaaacagtcagaagatgtcactgatgcaacaaagtcaaagaactcacatgcgatctgtgagcttgggctgtcaataatcaatcacttaactcagaaagagcctgatctacaaggggaaatcacacctgtatcgctgcctccgacgctgtacaaaccttctgaaaaagttgaaggagacaagtctcaggtaggtgaagaaaaattgtggctagctgatgagactgtcctgttacacttcagggctctcaagttggagagtcatgctgatgcatctgtgatcccccaaacttcagaaaatgaggttatgattgatggggaaagtgatggaaatgaaattcctctgggtaaaatagtagagcgtttgagagctcagggaaccaagactagaaagggcaaaaagaataaatctgtaccagctgaagatgagaatggtaaaaatgatgtcgatgttttgaagatggtgagggagataaatctagatcacttacaaatgctggataaattcgaatccagtaatggacacaaacattcccctagtgagagagcagagatatgtcaaagagatcagaagggtaacaaaaggaatgttggtgatgcaacatcagtagtttcagtccctaagcgccggagatcatcttctggccatagtccttacaagttctcaaacagtggtcctaaagttcaactgaaagcttctgaagatgagttgcatctagagagtgacatggacaaaaatgtctctttggactcgcacgatgaaaattctgaccaagagaaaatgttagaaagcatctctccccggaagagaaagaaaagcttatcatcaaaattaaagattacagaatctgattgggctctcaccgatgtggagaggcagagtaggtcagcaggaggtggtgatagcaaattaaagtctgcctctggatcaatgaaaaagcgaaaaaacgtgtcaggactggcgaagtgctctacaaaggaaaataaattggtaaatgatgaactgatcggttgccgaatagaagtttggtggcctatggataaacggttttatgaagggacagtgaaatcttatgattccacaaaacagagacatgtgatactttatgaggatggagatgttgaagtacttaacctaaagaaagaacagtgggagctcatagacactggtggaaagaccgcaaagaagtccagaacatcaaagggaaattcgaagaagaaaagatcttctggaagtaagcctaagaatccggatggcgtacagagggatgaagacccagttactactacgccaaaaggaaaaagaactccaaagaaaaacttaaaacagttacacccaaaagatacaccaaaaagtctttctttagaacatgagaaagtagagagcagaaacaagaaaagacgatcttctgctttgccaaagacagaatatagtggggaggctggcgaagaaaaatcagagtctgaaggaaagtcgttgaaagaaggtgaggatgatgaggaagttgtaaacaaggaagaagatttacaggaggcaaaaacagagtcgagtggggacgctgaggggaaagaagctgaacatgacgactcagatactgaagggaaacaagaaaacaatgaaatggagagagaagctgaagagaatgctgagacttctgacaatgagactcttggagcttggaagagtaaagtgggtaagtcaatctcgaggacagcaatataggtttgccgtatgccgtaatgtagaagaaattgcggtgattgtcctcaaaaattggtggtctctggattgctgtggtgtatatgtggtaaaaatgtgagacttgtagggttagtgatacatacttgttctaaccaccatgttggaaagaataataggcagaaagaagctcctccagaagcttttgtggtcatgtattgtagcctctgtgtgtgtttatttgtaggtttgttttacgttttttctttttctgtaatatttacaacttatattcctttacccaaagtactattctcttgttgaacttaactgctttgccaaattttttttgtaaacttcttttgtttattttatcgcttgtcaaa

SEQ ID NO: 93 - DNA, 1778 bp, Arabidopsis thaliana
gctcctttgaagagcttttaatctcttctctgaaaccctcccccagtgactcaccaccacgacaaaaaaataaaaaaacggcgtagtttcggttacttcgtcgtcgtcttcctcatttcgccggaagaattatccgccatgggagacgataagaaagatcagaagcagctttcttcatacttgaaagctaaaaacttttcatgtgattcacatttttcattttattggctaatgtcgaggctaatcttcttaattctcgccattctcttctctcttcaattcgttttctaccctttaaatttcatctcctcttcttctcaacctctgatcaaattctctgtttcacccgtcgtatccggatccgggtcggttcatgaaccggaccaaaccgaactcaagcacgtcgttttcggaatcgccgcctctgcgaaattctggaaacaccgtaaagactacgtgaagctctggtggaaaccaaacggtgaaatgaacggcgtcgtttggttagaccaacacattaaccaaaacgacaacgtttcgaaaacattacctccgatcagaatctcctccgacacgtctaggtttcagtacagatacccaaagggtctccgatcggcgatcagaatcacgagaatcgtctcggagacggtgaggctgttgaacggaacagagttggagaaaaacgtgaggtggattgtgatgggagacgacgacactgtgtttttcccggagaatcttgtcaaggttttgagaaagtacgatcacaatcagttttattacatcggaagctcgtcggagagtcatatacagaatctcaagttctcttacgggatggcttatggaggaggagggttcgcgattagctatccgttggctaaagcattagagaaaatgcaagatcgttgtattcagagatattcggaattgtacggctccgatgatcggattcatgcttgtatgtcggaactcggtgttcctttgactaaggaagttggcttccatcagattgatttatacgggaaacttctgggcctattatcggcccatccactggctcctctagtatcgatccaccatttagacttagtggatccagtattcccaaacatgggccgagtcaacgccatgagacgtttcatggtccccgcaaaactcgactcaccgagcctcgcgcagcaatcaatctgctacgacgcggaccaccgatggaccgtgtctgtctcgtggggatacacagtccagatcatacgtggcgtgttgtcagctagagagatggtgatccccacgcgcacgttcatcgattggtacaaacaggcagacgaaagaagctatgcttttaacacgcgtcctatcgccaaaagcgcgtgtcagcgtccgcgagtgtattacctgtccaacgcgcttcctgacttggctttgcgtagaactgctagtgaatacgtgagatggtacgacatgtgggagcctgaatgtgactgggatatgtcggatccttcggaatttgaacgggtcattgtttataagaaacccgacccggatagatggaataaacatagggctccgagaagagattgttgtagagtattgcccacgacgaagaatgggactatggtaatcgatgtaggagcttgtaaagatgatgaatttgctgaattccttgtcaaatagaattatttatcttttatagcgttttcttgttaccaatcgtatttttgaaatttcgagcttatgttttaacagcaatttcgagcttgtaaattatttcttaaaactttttt

SEQ ID NO: 94 - DNA, 1834 bp, Arabidopsis thaliana
attttcccacaattattattgttcagaaaagaaaagaaaaaacactcaaatgaaagatctcacgtgcggaaccaaactatgacctttgtctgaccattgcgtttctctctctctctcaattgttctatgaactttttttgataggactactgggaaggaacctggagaagcaagctccaccgccactacggcggagactgtggaggagagatcaggctccggaagatggcggcggccgagagatttaaagggtggcggcgatatcgaagggattccacaggttttgggtcgtttggtttcgaatggttcaagtaagattgcatgtctttacacacagcaaggcaagaaagggactaaccaagacgccatgctcgtctttgagaacttttgttcgagagacgatacagtgttttgtggtgtattcgatggacatggaccatttggtcatatggttgccaagaaagtccgagatacattgcccttcacactcttaacccagttgaaaatgacctcagagtcagatcaaagcagcttagttggtgccaatggttttcagatcaaatgtacagaggaagaagaagtgcagacaactgagtctgaacaagtgcagaaaactgagtctgttactactatggatgagcaatggtgtgagttaaatccaaatgtgaacaacgatgaacttccggagatgtatctgcctcttaaacatgcgatgctcaagtcttgtcagcagatagataaagagctgaaaatgcatccaactattgattgcttctgcagcggaacaacttcagtcactttgatcaagcagggtgaggatttggtggttggaaatattggtgactcgagagccgttcttgccacaagagacgaagacaatgctttgctcgctgtacaattaactatagacttaaaaccggatttgccaggtgaatcagcgagaatccagaaatgtaaaggaagagtctttgcattgcaagacgagcctgaggtagctcgtgtatggttaccaaacagtgattcacctggtttagcaatggctcgagcttttggagacttttgtctcaaagattacggattaatctctgttccagatatcaactatcgccgcctaacggaacgagaccaattcattattcttgctagcgacggggtatgggatgtgttgtcgaacaaagaagctgttgatatcgttgcctcagctcctagtagaagcacagcggctcgagctctagtggacacagcggtacgatcatggagaatcaagtacccaacttccaagaacgatgactgtacagtagtctgtctctttctacaagattcatcagtagccatggaagtctcaaccaatgtaaagaaggattcacccaaagaagagtctatagagagtgtcactaacagcacaagcaaggaggaggatgagattgtccccgttaaagacgagaaaatccctgagagttgcgggattgagtcgaaaatgatgacaatgacacttgcggaatgtatctcggttgcacaagatgatgaagagtggtctgctttggaaggattgacgagggttaacagtctcttgagcattccaaggtttttatctggtgagctcagatcaactagttggagaaaatggttgtgacttttttttgacttaagtgattctaagttaatgccgacaaaaacacttcatatcacgatgttccaactttttttcttcttctcttggaagtgatttgcagatatataatctttcttgtttaaattagtctttcagacatgtgagagattggtcatgttagctgtagataaagatcatagtgaattggatcttttcttggat

SEQ ID NO: 95 - DNA, 3689 bp, Arabidopsis thaliana
taaaactcgccgccgccgttcgccgactctgttaccgataagaaggtgaagtgatggattctgatgctagtgccaaggagaatacacaagatctttctgactacaagggaatgatagaaactggtggtgaaggcagtgttagagatgagctacaagaaccaggtttgatggtgaagcagagagaagttaaaggagttgaagcaagttatgcagttaaatgtgctaatactacagtgaagagaaagatggatcaacataaagaggcaatgttgggaaagaaacgaaataggcagactaggtttcttaatttggaagatgttaagcaagcaggtactgttaatacatctacacctaggagacagaactttgcacaggctgtccctacacgctccagtgcagttaatccacctgctgagcatggaggagaaagccaaagccaaagccatcaaaatctaaaatcagttgattttccttctactggcggtatacattcagaatctgctgaacagaagaccgaaagtaatggggaatcatattcaggtttacttggtaaacctaggaggctcaacagggatgaagaaccttctgctgaagggatgggaacatctgtatcaaggcaggcttcttggaagcagccggctaatatacggcagcccaagagcggtcattcatctagtagaaaagtatcttacagccaaagatctttcaagaagccagccacaagtagtacccaatatcaggatacatctgtggaacgtcttattcgagaggtgaccaacgaaaagttctggcgtcatcctgaggataccgaactccgaagtgtacctgagcggtttgaatctatggaggaatatgtcagagtttttgaacccttactttttgaggaatgccgggcacaactttacagtacatgggttgaactggctgaggctaatacatatgtgaaagttcgaataaaatccatcgaaagaagagagagaggatggtatgatgtaatacttaactccttaaatggctgtaaatgggctttcaaggagggagatgttgcagttctttcaactccactgcctgaatcagatgaagaccatgaggatgctggacgtgtcgctggtacagttaggagacatataccagttgatacccgtgaccctcgtggagctactctacatttctatgttggaaattctggtggcactggcagcaagattgatgatagtcatattttacggaagcttaaacctcaggatatctggcatctaacagtgcttggttcacttgcaaccacacagagggaatatgttgcacttcatgcgttttctcgacttaacccacagatgcaaaatgccattctcaaccccagtccggagcagtttcctagttacgaggagcaaacccctgcaacgcctgattgtttcactactagctttgttgaccatttacatagaagctttaatgctccgcagctggctgcaatccactgggcggccatgcatactgcagctggtactagtagtggggtgaagaagcaagaaccatggccattcactcttgttcagggtccgccaggaacaggcaagacacacactgtttggggaatgttgaatgttatccatttggttcagtatcaacaatattacacttcgttgctgaagaaattagcacctgaaacctataatcaagctaatgagtgcagcagttcagataatattttgtcaggctctattgatgaagtcctacaaaacatggaccacaatctcttccgcaccctgcccaaactctgtgctaaaccaaggatgcttgtttgtgctccttcgaatgctgcaactgatgaacttctttcacgtgtcctcgaccgtggttttattgatggggagatgagggtatatcgtcccgatgttgctcgagtcggtgttgattctcaatcgcgagctgctcaagcagtttctgtggagcgaagaagtgatcagctattagctatatcccgcgacgagattctacgacacatgcgtaacctcagactacaagaaacacagatttctcaaaatatagctggacttaaaagggaacttaatgctgcagcttttgctacacgttctcagggatctgttggagttgatcctgaagtccttatttcaagagaccagaaaagagatgcattgttacagcaccttgctgcggtggttgaagccagagataaagtacttgttgaaatatctcgccttcttattgtggagggaaagtttcgtgctggtaacaattttaatcttgaggaagcacgagcgagtcttgaggcaagttttgcaaatgaggctgaaattgtttttaccactgtatcaagcagtggtcgtaaactgttttctcgtcttacccatggcttcgatatggttgtcattgacgaggctgcccaagctagtgaggttggagttcttcctccccttgctcttggtgctgcgcgatgtgtacttgtcggtgatcctcagcagcttcctgcgacagtgattagcaaggctgctggaactcttttatatagtagaagtctctttgaaaggtttcagctagcaggctgtccgactttgttattgactgttcaatacagaatgcatcctcaaattcgagattttccttcaaggtacttctaccaaggacgcctcaaagacagtgaaagtatatccagcgctcctgatgagatttactataaagatcctgttcttaggccttaccttttcttcaatatcagccatgggcgggagtctcatagaggtggatctgtatcttacgagaatgttgatgaagctcgattctgtgttggggtgtacatgcatcttcagaaaactctgaagtcgttgggtgcgggtaaagtctctgtgggagtaataaccccgtacaaactgcagctgaaatgccttaagcacgagtttggcaatgctttgggccaagatgaactgaaagagatttatattaatacagtagacgcgtttcagggtcaagaacgtgatgttataatcatgtcatgtgtgcgtgcttcgggtcatggggttggctttgtttcagatatccggcggatgaatgttgctcttacccgtgcgagaagagctctgtgggtgatgggaaatgcatctgctctgatgaagtctgaggattgggcagcgttgatctctgacgcgagaggcagaaactgttttatggaaatggactctcttcccctggatttcccaatccctaaagtatctagttataatcccatggcacctaataatgggttaataacatcgaagctgtacccttcagacgcaccgatcataggcctgcacaccaaattacgttgaagctgtattggaaatgctgagatatgcacaaaatgacgttgaacgaacttgttgataatacccacgatgtgaagactctcaagacggttttgtcccaggacatgtactggattttgcttctctcttccagattattttttgttgtcatgaaggagaagaagataatgatcagcaatgctgtgaaatagggaatttaaagttcagagtataaatgaaaacaggtcttagaagatttgttagttttcttcacacttccatattagtatcatcatatagcacaactcgcattgtgttagcatcttgtatataatcctttatcatctcatattttaatctgcttcattataaaactcactttctttg

SEQ ID NO: 96 - DNA, 3600 bp, Arabidopsis thaliana
gggtttttgtttcttcagtctgtcgacgcttgctctctctctatttatcgaattccccgacggtgaacatcaccagacaaggaggaggagactaggaagatcgattttatcaatctcaattgaacaagatgtcgactctgttagctacatgtaaccaaaattgaaaccaaaactaagtttcttcttttgtagccttcttcatcattcaaaatatggcgaatagtaagtacgagtacgtgaagtcattcgaagtagaagacgaagttatgtttcccaatctgataattatccgtatcgatggccgtgatttttccagattttctcaagttcacaagtttgaaaagcctaatgatgagacatctctaaatttgatgaattcatgtgcatcttcggttttagtagagtatcctgatatagtctttgcatatggatatagtgacgagtacagctttgtattcaagaaagcatcaagattctaccagagacgagccagtaagattctgtctttggtagcctcattttttgctgcggtctatgtaacgaaatggaaagagttctttcctcatacaaaattagaatatgctccttcatttgcttcaaaagttgtaagttgtgcatcggtagaggttcttcaagcttaccttgcgtggagacaacatgactgccacatcagtaatcagtatgacacatgtctttggatgttagtaaaaagtggaaagaccttaagtgaaactcaggagattttgaaggatacacagaaacaacagagaaatgagcttctttttcaacaatttggtattaattataaaatgcttcctgtattatttcgtcaaggatcatgcctttttaagacaaagttggaagaaactgtaaagcatgatgagaatggaaagcctgtaaaacgattgaggagaagagaaactttagtgcattcagaaaatgttgctggaagaagcttttggaatgagcactcctctcttcataaagatcttggacattttgcaaaagacattggcaaaattgaaccagattatgttaagtcgtttcagtttgagagtagattattacctttaacttgggttgtggttaggattgatggctgccattttcacagattttctgaagttcatgaatttgagaagccaaatgatgagcaagctctgaaacttatgaattcatgtgcagtggctgttcttgaggagtttcaggatattgcctttgcctacggcgttagtgatgagttcagctttgttcttaagaataaatctgagctttacaaaagacagtccagtaagataatatctgcagtagtatccttcttcacatcgacttacatgatgagatggggagattttttccctcacaaaaaattgaagtaccctccatcattcgatggacgagctgtttgctatccaacatcagatattctcctggattatctagcttggagacaagtcgactgccatatcaacaatcagtataatacatgtttctggatgcttgttaagtctggaaaaagcaaaattcaagcccaggattacttaaagggtacccagacacgagaaaaaaacgagttacttagccagcaatttggaattgagtacaattcattacctgtaatcttccgcatgggttcttccgttttccgcctaaagacgcaggaaggtgttacagaggagaatggagaagtttcaggaaagcaagtggaagcagaagtgggcgtagactattcaaacattatcgaccaatgtttctggcaacaacatcctcacattcttagcttctcctaagacaggtattcattgctaccaaaaaaaaattccaaaccgaaaaccgaatgagattcagctcttattttgataaaccgaagctaaagtacaaaacaatcgaaccgaatggtttacttttttctttcactattttttgtttttttccattattttaaattaacctttttcaatttggtagttaattttttccttcaatgagagatttgggttgttaattttcctttgactggtaggataagcaatattagtgcttttcttttttttggtaaagtaagattcgtaaaatgtattgactaaaatgataaaagaggaagaaaatctcatccaaattttttgactaatatgttcatctaaggtaagttgacccaaagtgagatacattgtgttcttgcctaatgattactatagtagaatctcattccaagcacaacaatatttttaaattaatttcaaggggaattccctaattttcaattaatttgtatttataacacctaggtagatttttctctattaattgaaagaaagttccattactaattaattaattagagatttttaacttcaatcataggtgctaataacacaattaataatattttatttctttcattcctttttcaccattttaaaaaagtttattaattaaataaaaaaataagcgttacctccttcgacgatcagacgattctgccattgtcatacatttggcttagctcgtaacgtttcctctctctctctctctcgttccacaccactacattctccgtccgtcagaatcttcgaatttacctgttccgccaatcactcctcgcgtaatggagttgaagccggaggttcaatatggagatttttcgttaaccaacagcttagtgaatgtggacaaggaggaccttcgtagggaggaagcagatagcgacgcaggttcagtgattatctgcgaccattcgatatgtgatagtggtgatggtgatatatgcgctgtagcagattatgttgagtgtgtggcggtggagacgacggagaagttggagctgcctgaggaatttgcgaaaagcgttatggttctaacgtgcgaatccacagctgagggtggatcttgtgatgtgtacttagttggcactgctcacgtatcacaggtaatcctcgaatcatgtcgagaagttgaagctgtaatcagcgccttgaaaccacaggccgccaagaagcttgaggtttttcctggtgctgaatttcgtgtgggatttgaagaggcaaacaaatatggtggcagagtgtttcttggcgatcgctcagtacagctgaaagacctgggcgatggggatatgctgacattggcgattcaagaaatgagcacggaatttccgactctcatggagacacttgtgcatgagcgagataagtacatggcatatcaattgttgagaattgcaagtgagcatagttcagtcgtggcagttgtgggtagaggacatcttcaagggatcaagaagaattggaaccaaactataaacataaaggaactgatggagttaccgacaaatgaatccatatttactgtaaagaatattctgaaatatatggtggttgtagtcgttggaacagccatagtttccggaatgtatcttgctaagtaaattaatctcaaggtagagtgagtttctcatgaggaggataaaacttatgctgacataaaatttcagaacctgttaaaaacatatgctgtcatgattttatctacttttggttttaggatgaataatttcatataagaactatacaaaataaattatttcacattccatgtatc

SEQ ID NO: 97 - DNA, 4945 bp, Arabidopsis thaliana
ctagtaatccagtgcagcagaggtcctcctatcttaacgaaagctgtgattctccttcgtctttcaatatcattcttaggtttttgaaattcatgtgtcgtaagaaccgaggaagatgacgacaccaatcaccgggaaaaactctcctgttaccggaaaagaagaaggcgaactatctacctccgacgacgaagtacaaccaatgcaaacaagcacgagatctcctcttactgaacatatatcagcaaacacaaatatccaaaggcgtcaagctggaaatggtggatcttttattaagccttctgatgctacaccaacgaagctgacaaaccctggaggccggatttttgagacgaagcaagccattgctgccattcatgggaagaaatttcctgtaaggggcaacaacagcaacctcgtgataaacttctcagatgatgatagtggtagtgaatctgattgtaaaggacgtacacagacatcaaagattcaaccaaagggaaccatatctgggaatagaaacccgtctacattttcacaaacaaaattgaaaggaccaagacagattgatataagagccataacaaagaaggcattgtccactagcacctttagtcatgctgcgacgtccaaagtctccaacctttcatttgccaaggaaatgaaatccaataaatatattcattcctctgaaaggacggttagcaaagatgcacagcgtcctgaacagattgtggagtccaatagcaacaaacttcaggatttaaagcagcagattgcgcttcgggaaagtgagctgaagcttaaggctgcacagccaaagaaggatgccgttaacccaaaaatcactccagcaaggagggtcagtattatttctgatgatactagacatctagaaccaaacgaacctcccaagaaacgtttaaaagttagtggaattgacacaagtcagcctgttattgattacagagtggcagcatctgcggctgcaccaatgaatgcgccagacatccgcaaaagtctactgccaggtgtcaatgcaaattctagttgcaaacacctcggaagtaagagtgatgagattgttccacctgttattcctcagcatactgtggaaggaaatacaagctcaagtgtcttacaaaaaagcaccggcaaagtgaatcattacgaaggtggaagagaactcgaaacaatgaaaaatgttgataggagcgtgtcaagtgaacagttacttaaaatagtcaatggaaaccatcaggttttttctagatcctcaaataacaactggaagcggctgccttgttcgaataattctggcctctacaacatcccgggaagtacaacagttcctggacatagtcaactggatatgctatccttgacgaacctagaggaatcgcttgacaaagagttggaggaagcacaagaacgaaaacgcctttttgaaattgaagaaagaaatgctcttaaggtttatagaaaggcacagagatctttgatagaggcaaatgccagatgtgcagaactttacagtaagagagaaattttatctgctcattatggatctctcatcgttcgtgactccagattgttgtggccttctatacatggtgagaatcctgaaaccgggtttcacttcttgaataatagtactggaagcattgatctggcaaccaaaacggacattgctcagcattctcagctagaaagcaaccacaaatataacagtgaatatgttggcagtcatcctccacctcattcccgtagtggacagaatttggggtacagtgatcttggtgctagtacctctgatggattgccttgcggtaacaagcaaactgcaagtagactatgctccccatcaagtgatgcaaacattttgccagatgacgagtcatttccagttgaccatgaatctaccgaggggaaccctggacatcaaaaagaaaatattgatcaaacactaggcaatcagaatgctttgcttcttgaagcatcattaagatcaaaattgtttgaccgtctaggcatgagggcagaatctagaggtggcacatgtttcaatgaagagactgtgatagatagaggggatgaaagagatttcggaagtgaaggaacccagagagataacggtagtcctttctccgaaatatatctgcataatgattctctagagccaggggccaataaactgcaaggaagtccatccgaagcaccagttgaacgacgctcaatcgaggaaaattcgctaaattatcagttatctatagatatggagtcccataggagttcaccagagaatgcccttttatcgtctgtagcgttgtccggtcctttatttcggagcacaatctatcatttgaaagtcccagggtcttcaattacatctctgggaccagaatatatacttcaaaacaagacatatagcctatatagtgataaaagacaatgtaggagcttgacggaaactatagtatatgagaaaaaaattggcttctacacctgtaatttgaaggtggacccttcttggcctctctgcatgtacgagttacgtggaaggtgcaataacgatgaatgttcttggcaacatttcaaggatttctctgatgacagtttgcatcaaagtctacatgatcctgatggtagagttgggtcaagttcacatcagaagacacataattcttccaaaggatcccagattttggactcagtgttttcaccaacttatcttgtctccttggatacgatgaaggttgactcgtggtcttatgagtccgttctggctcaaagacatggacaaatatggtgcaagcactttagtgcctgcctagcctcatcaaactcgctttacaggaatgtacctgcaaaggaaaatgaaggtcgaattgtggtcctaggaaattcgaaaacatactcatcatacttcaggattaagcatagcttaatgtggcacatatttcaggccctttctttgctttcacaaggtcttgaaggtgacccaacttctgagattctttgggctgtttatctcctgatttaccatgcatatgaaggatcagatgggaaagatatgttttcttatggggtcaaacacagtagcagatcatacgtaatttggcttatgtacatcaacagtcgaggacaacttaatgatcaattaattgcatatgataccgccctctcagcactttgcaaccatgcatctgggtccattgacaggaatcatgccagcgcttgcatattagatgttttgttgcagatgttcaaccttttgtgcatttctgggaatgtttcgaaggcaatacagagaatatccaagcttcaggctccagcagcagtttctgatgaccctgacttttcactgatgtctcacattctcacatgcttaacatattctgacaaatttatttacaggaagctgcctgactctattatccgacgacttgaaatggagaaggaactacttgaaatagaatggcctactgttaatttggatggtgatctgaagcaaatggcgctcagactatttgataaagggatgcgttccgtagaacatggtaccaacaatggaatacaaaagcgacctgctgggctatttgctctgaactacgccctgtttatgattgcagtagatgagttagaaagccgtagggacattttgaaggcatctgttcaactctacccaacatgcttggagctaaaattgttagcagttaggatgcaatcaaatgagttaaaggatatgttttcgtctgggtttgaagagcttctcaagcaggaagcaaaagaggcgtcatgcatacagtgtatttggaatcagtatgctgaatatgctttggaaggaggaagctacgatttggcaagagaactcatgtcccggtggtacggttcagtatgggatgttttgtcccataagtataagacagtacgaggcaatgaagaagaaggggatgataatatgctggaatcagctttatcagatctaaatgttgcatcggatcaggtggatgtgatgtttggatatcttaatctctctctgcataatctactgcagagtaactggactgaggctcgcttggccattgaccaagcactaaaagcaacagctcctgagcatttcatgcactgtcttagagagcatgctgtgtttcagctaatcaacgagttgcaagcaacgggtgaattttcaatcaacctacaaatgagattactcaactcttatttggatcgagcaagttctttacctgtaaaagagccactatcttggaaattcattagcaacagcgctgagaaaccaagagtcaggaagctagttactaaccttctggctccagtttcatctgaactctttgtggtgaatgttgttcttgaagcatggcacggaccatctcttgtacccgagaagctaagtaagcaaaaggaactggtggattttgtggaaacaatcttagggttggttccaagcaattacccgctggctttgtctgtaagtaagctgttaaggaaagaagagaaacaatcagattctggttcctcctcgggtattcatttctgggcaggtctgaatttggcgagtacaatatcttgtgccatcccagtagctccggagtatatttgggtggaggctggagaaatagtgagtgatatcaatggtttcaagactagagctgagagattcttgaagaaagcattgtctgtatatccaatgtctgtgaagttatggagatgttattggagtttatgcaaaagtatagaagagagaaggggtattgagatcgaagaagcagccagaaagaaaggaatcactcttgcttgaaactattaagtcttttgatttttgtccccctatatatagcaaaagtaagagtaaagggggatttttggaaaagaaatgggaatatacagtttaaaaagttttaagtcaatacgaattatacgttta

SEQ ID NO: 98 - DNA, 2615 bp, Arabidopsis thaliana
tagacaattttccgcgggaaaatgaagatgcaaaagacgacgacgaaagacaaatttgcttgaattctttcagttttccggtgaaaattcgccggaatccatggctgcgactctgctgtctcaatgctaccgtatctacaattccgatgcgtgcaagtgtgtttcttctgagaatcaccagacgacggggaagcgaaatgggaatcgaaatctcgaattcgactcgggaatttcgaaaccagcacggctagtacttcgagaccgatacaaggtaactaagcaggtcaatgatcctgcgctgactagggctttacgtggtttcgctgattcccgtcttatggaggatgcactccaactgttcgatgaaatgaacaaagctgatgcttttctgtggaatgtgatgattaaaggtttcactagctgtgggttgtacattgaagcagttcaattttatagcagaatggtgtttgcaggggtcaaagctgatacctttacttatcctttcgtgattaaatcggttgcgggaatttcctcattggaagaagggaagaagattcatgcgatggtgattaagcttgggtttgtttcagatgtttacgtctgtaattctcttatatctttatacatgaagcttgggtgtgcttgggatgcagagaaagtgttcgaagaaatgcctgagagagacattgtttcgtggaattccatgatttctggatatcttgcgcttggagatggctttagctcgttgatgctgtttaaagaaatgctgaaatgtgggtttaaaccggacaggttcagtaccatgagtgctcttggtgcttgttctcatgtgtatagtccaaaaatgggaaaagagatacattgccacgctgttcgaagtaggattgaaactggtgatgttatggtaatgacatcaattcttgacatgtacagtaaatatggtgaagtgagttatgcggagaggatatttaacggtatgatccagaggaacatcgtagcttggaacgttatgatagggtgttatgctagaaatggccgagtcactgatgctttcctctgctttcagaaaatgtcagagcaaaatgggttgcagccagatgttatcacatcgattaatctgcttcctgcttctgcgatcttagagggtagaacgattcacgggtatgctatgaggagaggctttcttccccatatggtattggaaactgctctgattgatatgtatggagaatgtgggcagttaaaatcagctgaggttatatttgatcgaatggctgaaaagaatgtgatctcatggaactcgattattgctgcctatgtgcagaacgggaagaactattcagccttggagctatttcaagagctctgggattcatcgcttgtacctgattccacaacaattgctagtattctaccagcttatgcagaatctctatccttgagtgaaggtagagaaatccatgcttatattgttaagtctagatactggtcaaacaccatcatcttgaattcacttgttcacatgtatgccatgtgtggtgaccttgaggatgcaagaaaatgtttcaaccacatcttgttaaaggatgttgtttcatggaacagcatcatcatggcatatgcagtacatggttttgggagaatttcggtttggttattctctgagatgattgcttctagagtaaatccaaacaagagcacctttgcttcactattagcagcatgtagcatttctggtatggttgatgaaggatgggaatatttcgagtcgatgaaaagagaatacgggatagatcctggaatagagcattatgggtgcatgctggatctcattggccgtacaggaaacttcagcgcagccaagagattccttgaagaaatgccatttgtgccaacagctaggatttggggatcgttgttaaacgcaagcagaaaccacaaggacataaccatagctgaatttgcggcagaacagatatttaagatggaacacgataacacgggatgttatgtcttgcttttgaacatgtatgcagaagctggaagatgggaagatgtaaataggattaagcttctcatggagagcaaaggcatatccagaacatcaagtcgcagtactgttgaggcgaagggcaaaagtcatgtgttcacaaatggagacagatcccacgtggcgacgaacaagatctatgaagtcttagatgtcgtctcgaggatggttggagaagaagacatttatgttcactgtgtctcgaggttgagaccagagactctagttaagagcagaagcaattcaccaagaagacattcggtaaggctcgccacgtgttttggattgatctctacggaaacgggaagaagagttacggtgaggaataacacgagaatctgcagaaaatgtcacgagttcttggaaaaagcttcgagattgacgagaagagagatcgttgtgggagattccaagatttttcatcacttctccaatggtcgctgctcgtgtggaaattactggtgaaaacacagattgtggctaaagtaggtatatgtatgttgtcagactaatgtaaaaagaagaaaacatgttttagcaactaaagttattaatgctaaaaccc

SEQ ID NO: 99 - DNA, 5158 bp, Arabidopsis thaliana
tgtaaattaaacttcaccaatctccattgcctgttggcttcggagaaaaaatgcctccaggggttcgccaacttaccgtcctcggaaagtttaaacctttcggtctaatcgccgaagctactgatggtaaatcaccggatgattcctatcagtatttcctcttcgatcctgagctcactggcgagcgagatgatgctgatggcaatgatgccaacttctcgcggcagagagagcacgagctcttcatccgagacaactgtaatgtccgtaagggttatgctttagtagaagctaatttcattggatattggtataacgcatgctggagcaaccttggtcgagggacagaagcttttctttgtgtattacaaattgcttgcttaacaatctacaacacatcaggcgaagttgtatctgttccactaatgcgtactgtcaaatcaatatggcctctaccatgtggtctacttcttgagcaagctggtgaagtgaatccaccctcacatgttccattttctcctgttagccccatccttggttctcgtgagatgctgcgccaaagaaaagaagttgggaatagttcaccacaaaacttccattccccagtcgcgcatgaccttattagcaaaagagatatgccatgcatgtcttcccatctgattctaagagatccactagaggaacctgggccaacctacgttgaagagagggggaagttgaccataatgaaggactacgatgagaggacaatttggacaagtgaccgtctacctcttatgacgtcgtataacaaaggcaagatgcaacattctgtgtgggcggccgaatttatagagtcaaaccttgaagcttctgcgtcatgttcaagcggcattgttcctgatgctgttctctcgaagcgggtttcttttcgtagaatatggcaagcgaaaggtgctaagaaagctgcatctaaggtctttttggcaactgataattcagtcccagtaatttgctttctgattctagaacaaaagaagctgttatcggtgggacttcaaactgttgaaatcaataacgaaattctgttcgatgttaagcctgatataagctggagtgtgtctgcgattgctgctgcacctgttgttgtgacacgttctcaagtgaaaataggactgcttccacatttggatatcattgttttatctccagaaaatgacctctttctctattcaggaaaacaatgtctctgtagatatgtattaccttcttggttgggagaaagtattggttccggggatggagagtctgcaaaaacagattcaggtttcaggaacctgaagatcacaggattgtctgatgctgttttaggatctatcaatctctcagttaaccattcacagatctttcggtgtgccttaactggtaaaccttcatcgtcacttgcaaatgattgcatagcagccatagctgagggactacgatccgatctgtacagtttgtttctctctcttctttggggagatggtcattctgacctgcaaggttccagtattcattttgaatgggaagcattatgcaacatttttctggagatctgtcaaaagcctactgttgtgcatcgaaagcaacccaaaacagcatcagagtcctcctgggagtttcttctcatcagcaaatttcataagacctactctaggtttcacaatggtattacttcaataaatcgtttagatctggaaggcattgtcccatttgattccaagatttgtagtgaagaaacactgggcagctcatgtgaactaatggtccagagtttagattgtctccatgcagtttatgagagcttgaagatggataatctacggaaacaggatttgcatcacttggctgttttgttgtgcaatattgccaagtttctggatgagaagtgttacttagattactacatacgtgattttcctcgtctgtcaacaactattggggcgtgcacaaccctttcttctagcagaaaacctccaaatttatttagatggcttgagaattgtttaagacgtggatgtttatcaacaaactttgatgacctcccagatttgatccgtagagatgggtgctccatagtaagctgggcaaggaaagttgtttccttctacagtgtgttatttggtgataagccagaaggacggacactttcatcaggtgtcccctgtaatatcgcgccaggatcatactcctgtaacgaggaactcactatcttagctatggcaggagagagatttgggcttcaccaactggatttgctaccttctggtgtttctctcccgctaagacatgcactggatagctgtcgggaatctcctccagctgactggccagcaattgcttatgtgcttcttggtcgagaagatatggccctatccgtcttcagaaattttagttcatctaaggaatttgagatgcagtcaaatacgagtttgatatcgatgtccataccttacatgctacatttgcatccagtaattgttccatcctctgagtcgattggcttagaaaacactaagattgaggatacaaattctgtggatggttctgtgatagatggaatggagcatatcttcaactcctacacacagctacggtatggccgggatctaagattgaatgaggttagacgtcttttgtgctctgcaagacctgtggtagttcaaacggctgctaaccctactatatcagatcaggagcagcaacaggcgtttactgtaccaaagcttgttttagctggtcgactgccttctcaacaaaatgccattgttaatctagatccaaacataaggaatatccaagaattaaagacctggccagagtttcataacgctgttgctgctgggttacgactggctccgcttcagggaaaggtctccagaacgtggattagatacaataaacctggagagccaaatgctgttcatgctggacttctgtttggcctgggattacagggatatttgcatgtgttaaaccttagtgacatataccaatatttcactcaggaccatgagagcactacggtaggtttgatgcttggtctggccgcttcatacaggggaacaatgcaacctgatattgcaaaggctctctttttccatgttcctgctcgataccaagcttcatatactgagtttgagataccaacacttctacagtctgcagctttagtctccgttggcatgctatttgaaggatcagcacaccagcagacaatgcaattacttttgggtgaaattggccgtagaagtgcaggggacaatgtccttgaaagggagggttatgctgtatctgcaggattctcacttggtcttgtagctttgggccgtggaggtgatgcgctcggttccatggactccttggtcaatcgcttactcctgtatttaggagcaaaagaggaaagatctatccttgtaccatcccttgaagatcaccgaagtgctgcacagataacagacggaagcacttctaatgttgatataactgcacctggagcgataatagctctcacattaatgtatcttaagacagaatcagaggtcatcttctcaaagctctctattcctcaaacacattacgatttggagtgcgttaggcctgatttcattatgctccgtgtcattgctcggaacttgataatgtggagcaggatctgtcctacttgtgattggattcagtctcaagttcctgaagtagtcaaaaatggtatcagccaactccgagatgacatggataatatgtatgaggtggatgttgaagcccttgttcaggcatacgtcaatatagtggccggggcctgcatttcacttgggctgagatttgctggtacgagggatggaaatgctcgtgacttacttaactcctacgctctctatcttttgaatgagatcaagcctctttctgccacacctggaaatgcatttcccaggggaatatcaaaatttgttgatcggggaacacttgaaatgtgtctttatcttatcattatttctctgtcagtggtcatggcgggatctggagacttgcaagtttttcggttgttgagatttctccgcagccgaaactctgccgatggacatgctaactatggcacacaaatggcagtgagcttagccacaggattcttgtttcttggaggcggtatgcgaacattttcaacgaataatggctcactggcaatgttgctcattactctctatccacggttgccttctggaccaaatgacaaccgttgtcacctccaggcattcaggcatttatatgtccttgcaacagaggctcgctggctgcagaccattgatgttgattctggtctgcctgtctatgcccctctagaagtcacagtaaaagagacaaaactttattcagaaacaaaattttgcgagataacaccgtgcattctgccagagcgtgctattctaaagagaatttgtgtatgtggtccccgatactggccccaacaaattgagctagtttttggtttaaggactctgggagaatctaatttgattgctaatagtcatagagaactggattctgatagtgttgatcacttggtcagcactttctcatcagatccaagcctaatagcgtttgcacagttgtgctgtgacaaatcttggaataacagctttgatttcctaattttggatctaatcttatggtctcaggttgctcttgcctacaatgaggcagtatcaactggaagattggcctcctcaggtggctttgtacagtcaatcttcttagcatcgctgagaaagcgatgtgaagaggttttgaattgctcaacggagctgaagattaatttgaggaattatttgacctcagaagcatggccttatgataagaactcaaagttgcagaaagatataattattctctcatggtatctaaaatggttcaacgtaccatctccatcgatcatcaaagcagcagtggaaaagatcaaatccaagtccaaaaactcaacttcggcaatacctttgttgcgattgttgttaccaaatacgcatattagtgtgattggtgaaattgatagggtctttttcccctcgaattaaacaattgtattgtgaaaacatgattttgtattctcttcgtttgggctaataagctgataaattttgtgagc

SEQ ID NO: 100 - DNA, 511 bp, Arabidopsis thaliana
aaacaaagaatctaaatcctatgttcttgttcttcacgatgagaatcttgaaaactcaaagatccagaggaggaagaagaacaagcaagaaatttggaaacagaagaacaagtggaggagaaaagttctcggagaagcttcaggcgcttaagagtcttcttcctccgccgtcgaagatgacggagcagagtcgtcaagatgcttacgtggaagaagattccagtgttggagagacggaacagttgtttcaagaaactgcggattacattgtcagacttaggggacaagtcgtggtgttgcaaaagttaatcgagatttatggatcatctgatcagaaggaagataattttgtttcataatgttcatattaaattatgataatgtttttcattaagcttttttcaatgtgttacgtattttgaacctaatatggtttttaggtagtcacgatgtataatgtttgattttgacgaacgaaaagaatgaaatcggtcaccatcagttacaaagc

SEQ ID NO: 101 - DNA, 1845 bp, Arabidopsis thaliana
attgctatataaaaagagccaagtgtccaattcctgatttcagatgaagtaaaagacaaccaaatatgagtttatgctctgatctcactgagaaattagacgaggagattttagaggacttgacgtccaatgtgaagcaaatacaagacaacgtattggaggagatactcacacttaatgctaacacagagtatcttcgacgttttctccatgggagctctagtaaagagcttttcaagaagaacgtccctgtggtgacctacgaggatgtgaagccttttatcgatcgtgtcacgaatggagagccctctgatattatctctggcaaccccattaccggattccttctaagttctggaacatccggaggaaaacagaagatgtttcctcgtaacaacaagtacttggaaaacataaaattcatcttttattaccgatcgctcgttataagcaagcatatagatggtcttgaacatggaaagggaatggtatttaacttttgtacatcagagaacacaactccttctggtttgccatcatcagctgcatcgacgagcttcttcaagagtgattatttcaagaaccgaccatcgtattggcattggtcttacacaagccctgacgaagtcatattgtgttcagacaccaagcagactttgtactgtcatcttctatgcggtcttgttcaaagagacgatgttgtgaaggttggtgccgcctttgttactattttggtccgagcaataaatcttcttgagaattcttggaaggaaatttgcactaatatccgttttggtcatcttagtgagtggatcactgatattagttgtagagactccgtttcaaagattcttggagagcctaatcctgaattggctgatctcatagaaaatgaatgcaacaataaatcatgggaaggtatagttccaagactttggcctaaagccaaattcatagaatgcattgcaaccggtcaaatggctcaacacatcccaacattggagttttactctaacaagttgccatcgatttcctcgagttacgtatcttctgaaactatgtttggtattaatatgagtcctctttgcaaaccagaaaatgtatcatacacatttctgcccaacttgtcatattttgagttcctacttgttgatgccggtgacaaaaccgaaattgttgatctcgtggatgtcaagttagggtgctattacgagcccttggtcacaaatcattccggcctacacagatataagatgggtgatattttactggtgactggattttataataatgcacctcaatttagatttgtgcgtagaggaaatctgactctaagtattcatttggagataactacagatgaagaccttttaaacgcggtcacagacgcaaagatggttcttgaatcatcaaatttgatgttgatggacttcacaagctatgcggatatttctactactccgggtcattatgttctttattgggagctcaaagcaaaataccgcaacgacattgttgaaatcgataagaatgttttggtagaatgttgctatgtggtggaagaatcattgaacaattcttatagagtatataggagtaaaggtggattaattggagctttggagataagattggtgcagcaaggaacttttgatgctctcatggagtttttcatcactcaaggtgcttcttcaactcaatacaagacacctatttgcatcaaatctactgaggccttggtgattttagaagaaaatgtccatgcttgtttctttactgataagtccctttctttgaacttttcgtcataatctctatattatgtaggcattgaaataaaagctc

SEQ ID NO: 102 - DNA, 1653 bp, Arabidopsis thaliana
ggactgaagatgtcaggattcgaagatggattttcagctgaaaagctattctcacaaggatactcatacacctacgacgatgtgatatttctaccacacttcatcgacttttccactgacgccgtctcgctatccacgcgtctcagcaagcgcgtcccactctcgatcccatgcgtcgcttcgccgatggacactgtctcggaatcccacatggctgctgcaatggctgctcttggaggaatcggaatcgtgcactataactgcgacatcgatactcaagcttccgttatccgtcacgctaaatcgcttcaagttccgattgcgtctgatgctgtttttaaatgcccagagcaccagattggttctgttgatgattttggtccttcttccttcgtttttgtctcgcagacgggaacattgacaccgaaattgttgggttatgtttcaaaatcggagtggtcgagtatgaaagatgaccaaaaggaggtgaagatatatgattacatgaagagttgtgagaacaaagattactatgtgccatgggatattgatcttgacaagattgaggcggttttggaagataagcagaaagggtttgttgttctggagaaggaaggtgagactgtgaacgtagtaacaaaagacgatgtggagagggttaaaggatatcccaagttagggtcaggaactgttggtgcagacaagaaatggatggttggtgctgctatagggacaagggaatcagacaaggagaggctagagcacttagtgaaagctggagctaatgttgtggtgttggatagttcgcaagggaactcgatttaccagcttgagatgatcaagtatgtgaagaatacgtatccggagttggatgtggtcggtgggaatgtggtgactatgtaccaggctgagaacttgatcaaagcaggagttgatgggttaagagttggtatgggatctggatctatatgcacaacacaagaggtttgtgccgttggacgaggacaggctactgccgtgtacaaagtctcgacactagctgctcagcacggtgtacctgttatcgcagatggtggcatctcaaactcaggtcacattgtgaaggctctagttctgggagcatcaacggtgatgatgggaagcttcttggctggaagcaccgaggctcctggagcctatgaatatcgaaacggtaggagagtgaagaaatacagaggtatgggttcattagaagcaatgaccaaaggaagcgaccagagatacttgggagataccgcgaaactcaagattgcacaaggagtggttggagcggttgcagataaaggctcagtgttgaagtttataccatacacaatgcatgccgtgaagcaaggttttcaagatctcggtgcttcttctttgcagtctgctcacgagctattgagagataatacccttagactcgaggctcgtaccggtgcagcacagatagaaggtggaatccatggactggtgtcttacgaaaagaaatcgttttagctttccccagtttactttcttatgttacaatgcactacagcacttgtagtgtcaacaataaggtcttgtctcacatgtaatcctgtaatagttgaatcgtgtttcttaatgctatttcactgccccatttcaatc

SEQ ID NO: 103 - DNA, 1605 bp, Arabidopsis thaliana
atggaagctctaatgcttatcttcacgttctgtttcatagttctctctctcatattcctcatcggaagaatcaagcgaaagctcaaccttcctccgagtcctgcatgggcgttaccagtgatcggtcacctccgtcttctcaagccaccactccaccgtgttttcctctccgtctctcaatctttaggcgacgctccgatcatctccctccgtctcggcaaccgactcctattcgttgtctcttcacactcaatcgccgaggaatgcttcacgaagaacgacgtcatactcgcgaaccgacaaaccaccatttctacaaaacacatctcatacggcaactccaccgtggtctctgcttcgtacagcgaacactggagaaatctccgccgcatcggcgccttagagattttctcggctcatagactcaatagcttttcctctattcgccgcgatgagatcaggaggcttataggccgtctcttacggaactcttcttacgggtttactaaggttgagatgaaatcaatgttttctgacttaacattcaacaacatcattagaatgctagccggaaagtgttactatggagacggtaaagaagatgacccggaggccaaacgcgtgcggacgcttatcgcagaggctatgagttcttctggtcctggaaacgctgctgattatataccgatcctgacttggatcacatattccgagacacggataaagaagctcgctggtaggcttgatgagttcttgcaaggattggtcgatgagaaacgagaaggaaaggagaagaaggagaacacgatggttgatcacttgctttgtctgcaagaaacccaaccagagtactacatggaccgcatcatcaaaggaaccatgctttctcttatagcaggggggactgatacaacagcggtaacattggaatgggcattgtcaagcttgttgaacaatcctgaggtgctgaacaaggccagagacgagatcgacagaatgatcggtgtagacaggcttttggaggaatcagacatcccaaatcttccttatctacagaacattgtatctgaaacgttacgtctgtaccctgcagcccctatgctgcttcctcacgtagcctcgaaagattgtaaagttgggggatacgatatgccgcgtgggacgatgctattgactaatgcatgggctatacacagggatcccctgctatgggatgatccaacgagcttcaagccagagaggttcgagaaagaaggagaggctaagaagctaatgccgttcgggctaggaagaagggcatgtcctggatccggtttggctcagcggctagtgaccttgagtctcgggtctttgattcaatgttttgaatgggagaggattggagaagaagaggtcgatatgactgaaggtccaggactcacaatgccgaaagctagaccgttggaagctatgtgcagagcacgtgactttgttggtaaaatcttacccgactcctcttgagtttttgtatgtaaaatgctaatacgttgcttagcaacggtaacgaattaaatgaaacgtattagcataataaaaatcagagacaaaaatcatattctaatttcc

SEQ ID NO: 104 - DNA, 4025 bp, Gossypium hirsutum
ctcctctatatccctttttgtatttttcatacaacaaaaaaaaaatgacaccttcggccggttcattttccggcgaccgagatgatgacggcgatgccacgaagaagaagaagaagcaacggaaagttccattgttgaagctgttttcatttgctgatttttatgaccatgtgttaatgggattgggatcactaggtgcatgtgtgcatggtgcttcggtgcctgttttcttcattttctttggcaaattgattaacattataggaatggcttatcttttccctaaagaagcttctcataaagttgcaaagtattcgttggattttgtatatctcagtgtcgctattttattttcatcatggatagaggtggcttgttggatgcataccggagaaagacaagcggcaaaaatgaggatggcatatctaaaatcaatgctaaatcaagatataagtttatttgacacagaagcttcaactggagaggtcatttctgcaattacaagtgacattattgttgttcaagatgccctttctgagaaggttgggaatttcatgcattatataagcagattcatagcaggtttcagcattggctttgctagagtatggcaaatcagccttgtaactctctccatagtcccattgatagcccttgctggtggcatttatgcttatgttgccactggtctcattgctcgagttcgaaactcatatgtcaaagctggtgaaattgcagaagaggtgattgggaatgtaagaacagtacaagcatttgcaggggaagaaagggctgtgaaatcatacaaggatgctttgatgaacacatacacatatggtaaaaaagctgggttaacaaagggtcttggccttggttcactgcattgtgtgcttttcgtttcgtgggcattgcttgtttggttcacaagtattgttgttcataaaaacatcgcaaatggtggggattctttcactacaatgcttaatgttgtcatttctggcctgtcgttaggacaagcggcaccagacatatctgcgtttattcgagcaagggcagctgcgtatcctatattcgagatgatagagaggaacacagttagtaaaaccagctcgaaaacgggccgtaaactaagcaaagtggaggggaacattgagctcaagaatgtatctttcagttatccgtctcgccccgatgtggtcatcttcgataggttctgccttaacatacctactggaaagattgtagctcttgtcggagggagtggctcggggaaaagtacggtcatatcattaatcgaaaggttttacgagccacttgcaggagaaatattgttggatgggaataatatcaagggccttgacctcaaatggcttagacaacaaattggtttggttaatcaagagcctgctctttttgctactaccattagggagaacattctatacggaaaagacgatgctacagtcgatgaaataacgcgtgccgcaaaactttctgaggccattgcctttattaacaatctccctgatagatttgagactcaggttggtgaaagaggaatacaactatcaggtggacagaagcaaaggattgcgatatctcgggcaatagtgaaaaatccacctattcttttactcgatgaagcaacgagtgcccttgatgcagaatccgaaaagagtgtgcaagaggcacttgatcgtgtgatggtggggcgaacgacggtggtggtagctcacaggctttctactattaggaatgcagatgtgattgctgttgttcaaaatgggaagattgttgaaaccggtactcatgatgagcttatttcgaacccgaacagtacttactcttcgctcgttcagcatcaagagacatcgcctttgcaacgctacccttcacaaggtcctactttaagtaggccactcagtgtgagttattcacgagaattatcccgaacaaggacgagctttggtgcaagttttcgttctgaaagagactcagttagccgtgctggtgctgatggaatcgatgcagggaaacaaccttatgtttcacctggaagactgtattctatgataggacctgactggtattatgggttctttggtaccgttaccgcattgattgccggagctcaaatgcctctatttgctctcggggtttctcaagctctcgtagcctattacatggactgggaaacaacgtgccacgaagtcaagaagatcgccatcctgttttgttgtgcttctgtcataacggtcatcgttcatgcaatagagcacctatgttttggcatcatgggagaacgactcactcttcgtgtgcgtgaagggatgttttcagccatcttgaaaaacgagattggatggttcgatgacttaaacaacgcaagttccatgcttgcatctcgtctcgaaaccgacgccacgtttctaagaggtgtagtcgtggaccggacatcgattctcatacaaaacgtaggcttggtcattgctgccttcatcattgcattcatcttaaactggagaatcacacttattatcttggccacttttccattgatcataagtggtcacattagcgagaaactattcatgcaaggctacggcggtaacttgagcaaagcatatctaaaagcaaacatgatcgccggcgaggctgtcagtaatatgcgaactgtcgctgcattttgcgctgaggaaaagatccttgatctttatgcccgtgagctcatagagccttcggaacgttcatttaaacgtggtcaaattgcagggatattctatgggatttcccagttcttcatcttctcatcttatggccttgccttatggtatggttctgttttaatggggaaggagctagctagctttaaatcggtcatgaaatcgttcatggtgttgattgtgacggcattagccatgggagaaacgttggcactggtcccggaccttctaaaagggaaccaaatggtggcatcggtgttcgagattatggaccggaagacgcaggttgttggggatgctggcgaagagctaacaaatgtggaaggtaccattgagctaaagggtgttcactttagttatccgtcgagaccggatgtggtgatattcaaggattttgatctgaaagttcgttcagggaagagtatggcgcttgtgggacaaagcggatccggtaagagctcagttcttgctcttatacttcggttctacgatccaacatctgggaaagtgatgattgatggcagagacattaagaaactaaagctcaaatcccttcggaaacatatcggattagtccaacaagaaccagctcttttcgccacttcaatatacgaaaacatcctatacggcaaagaaggagcatctgaatctgaagtggtcgaagcggctaaactcgccaatgcacatagtttcataagttccctccccgaaggttactcaacaaaagtcggcgagcgaggggtacaactctcgggtggtcagaaacaaagagtagccattgctcgagctgtcctcaagaaccccgaaatcttgctgctcgacgaagccactagtgctctcgacgtcgagtcggagcgcgtggtgcagcaagctctcgaccggttaatgaggaaccgaacaacggtaatggtggctcataggctgtcgacaattaaaaatgcggatcgaatatcggtcattcagggtggacgaataattgagcaagggacacattcgagcttaatcgaaaatcggaatggaccgtactttaagttaatcaaccttcagcagcagcagcaaatggaacaatagtgtcaaatttcagtaagaaaatgaagaaacaggttatgcagttgctttgtttaaatattttactttctttttttcactaaatttggattcatcttaactagagccattctttccatatgaagaaaataataataatacatatggaagaatattgtaacaagtgggatttttttacaataacatggatatgattaaaggtgttaataaatcagattggattgagtttgggcc

SEQ ID NO: 105 - DNA, 212 bp, Arabidopsis thaliana
atggctgcttcgttgtctaatttcagcgtcttggcttcagagatcaaacctacaggaagagttgataatcaatgcaaggagatgtgttcggcaacgtttggggacggtaaatgtgccgcagactgtaggaaggctggtttctcatccggacgatgtcttacttcttctcctttcggaaataaatgttgttgcacctagtgatagctagaacc

SEQ ID NO: 106 - protein, 345 aa, Arabidopsis thaliana
MMNLSSRRASSTLTLSFTVLLLASTGSYGSTFTFANRCGYTVWPGILSNAGSPTLSTTGFELPKGTSRSLQAPTGWSGRFWARTGCKFDSSGSGTCKTGDCGSNSVECAGLGAAPPVTLAEFTLGTGGDDFYDVSLVDGYNIPMIVEVAGGSGQCASTGCTTDLNIQCPAELRFGDGDACKSACLAFRSPEYCCSGAYATPSSCRPSVYSEMFKAACPRSYSYAYDDATSTFTCAGGDYTVTFCPSSPSQKSTSYSPPVTDSSSTSQGSDPVPGSDTGYAGQGQQTPGQGNVYGSQGTGSEMGTGETMLQDGSWMAGLAMGEASRPAGVSLTVLLAAFTFPFIFS

SEQ ID NO: 107 - protein, 545 aa, Arabidopsis thaliana
MSLLLLFCCFFTSLSISHSHGASTIHISPTQPPAASSEKTGSVMKFIVAEAPLLGPAGFNNPQVIEVASVALAAQRTYRKDPLNGFEKYTGGWNISNQHYWASVSYTAVPLFVLAAVWFLGFGICLLVICMCHICHRTNSVGYSKVAYVVSLIFLLIFTVIAIIGCVLLYSGQIRYNKSTTETLEYVMSQADSTISQLRAISDYLASAKQAAVLQVLLPANVQTEIDQIGVKLDSSVATITEKSTNSSNHIRHFLDSVRVALIVVSIVMLVVTFLGLVSSIFGMQVIVYTLVILGWILVTGTFILSGTFLVLHNATADTCVAMSEWVERPSSNTALDEILPCTDNATAQETLMRSREVTGQLVELINTVITNVSNINFSPVFVPMYYNQSGPLLPLLCNPFNHDLTDRSCSPGDLDLNNATEAWTSFVCQVSQNGTCTTTGRLTPALYSQMASGVNISTGLIRDAPFLVQLQDCSYAKQTFRDITNDHCPGLQRYGYWVYVGLAILATAVMLSLMFWIIYSRERRHRKEALPEFSESKEIVRVNF

SEQ ID NO: 108 - protein, 620 aa, Arabidopsis thaliana
MEKFAPVAALLLLLLCFPVAFSGHDYGQALSKSLLFFEAQRSGVLPRNQRVTWRSHSGLTDGKSSGVNLVGGYYDAGDNVKFGLPMAFTVTMMAWSVIEYGNQLQANGELGNSIDAIKWGTDYFIKAHPEPNVLYGEVGDGNTDHYCWQRPEEMTTDRKAYRIDPSNPGSDLAGETAAAMAAASIVFRRSNPVYSRLLLTHAYQLFDFADKYRGKYDSSITVAQKYYRSVSGYNDELLWAAAWLYQASNNQFYLDYLGRNGDAMGGTGWSMTEFGWDVKYAGVQTLVAKFLMQGKAGRHAPVFRKYQEKADSFMCSLLGKSSRNIQKTPGGLIFRQRWNNMQFVTSASFLTTVYSDYLTSSRSNLRCAAGNVAPSQLLSFAKSQVDYILGDNPRATSYMVGYGNNFPQRVHHRGSSIVSVKVDRTFVTCRGGYATWFSRKGSDPNLLTGAIVGGPDAYDNFADRRDNYEQTEPATYNNAPLLGVLARLSSGHSGYSQFLPVVPAPVVRRPMPIRRPKVTTPVRASGPVAIVQKITSSWVSKGRTYYRYSTTVINKSSRPLKSLNLSIKNLYGPIWGLSRSGNSFGLPSWMHSLPSGKSLEFVYIHSTTPANVAVSSYTLA

SEQ ID NO: 109 - protein, 216 aa, Arabidopsis thaliana
MAEKEKKTKKKKKKEKHQSSDISFKPSSDVKGLKFGGQIIVKSFTIRRARTFELLKLLSLPSSSSPPLLSTAAYLPTNFTILAHHAWHTLTLGLGTRKSKVVVFVFETEAMKSSVVAAEGGIWPSEIPLGDVNKKMIRKLKNWEMARFKFRKGCITFYVYAVRNAGNEGFAAAEDLKVILQAVVALKDFMDHTAMLVMPHQKSINYSSCPPFAMAH

SEQ ID NO: 110 - protein, 1047 aa, Arabidopsis thaliana
MDSAIEISSGSDSDDEVPPQPVWPQTRTRMDPTWLSRRPLPTVDSHARAEHTNQAPPNGASSDTSRPGVSKPFTGNGNTVNSRISSGSGADYVRLSSEQALKRTLPPSFNSPPLPARSGTNNISNASGSRVGVDYERPLSQQALKRTLPPSFNPPPLPSRSGTNNIRNAGGSRFGADYSHPAVSAVGNKSTFGDHYSGAHAEIGIQRGVNGVRILPPSLTHGTSASVLHHAGSSDPMHRFGGGEDRNPDNDERLVYQAALQVLNQPMTESDLPPGTLSVPLMRHQKIALAWMFQKETSSFNCPGGILADDQGLGKTVSTIALILKQKIVSQLKSESSCKQETEALVLDADDESDNAKHESGSHVKPELKVSSNSETSVLSACGNDENDSSDMEKAEDEEANSSTRAFQWKRPAAGTLIVCPASVVRQWARELDEKVSEESKLSVLVYHGSNRTKDPNELAEYDVVVTTYAIVTNEAPNKFLVDEDENDEKNTDRYGLASGFSNNKKRKVVVGASKKSKRRGRKSTNDTSSEPDCGPLGKVGWFRIVLDEAQTIKNYRTQMARSCCTLRAKRRWCLSGTPIQNTIDDLYSYFRFLRYDPYAVYKSFYSTIKVPISRNSCQGYKKLQAVLRAIMLRRTKGTLLDGKPIINLPPKVVNLSQVDFSVAERSFYKKLEADSRSQFKAYADAGTLSQNYANILLLLLRLRQACDHPQLVKRYNSDPVGKVSEAAVRRLPREARSRLINRLESSSAICYECNEPPEKPVVTLCGHIFCYECVLEYITGDENTCPVPRCKQQLARDVVFSESSLRNCTSDDSGCSSSHDNGLDRSVFQKRDFCSSKIKAVLDILQSLSQPDSPNSAQHGQMPSSSRPYDDDDVTIVEPMRLHSSSPSQGAVKTIIFSQWTGMLDLVELRILESGIEFRRLDGTMSLAARDRAVKEFSKKPDVKVMLMSLKAGNLGLNMVAACHVILLDLWWNPTTEDQAIDRAHRIGQTRPVTVTRITIKDTVEDRILKLQEEKRTMVASAFGEEHGGSSATRLTVDDLKYLFMV

SEQ ID NO: 111 - protein, 608 aa, Arabidopsis thaliana [sequence omitted]

SEQ ID NO: 112 - protein, 341 aa, Arabidopsis thaliana
MDHAADAHRTDLMTITRFVLNEQSKYPESRGDFTILLSHIVLGCKFVCSAVNKAGLAKLIGLAGETNIQGEEQKKLDVLSNDVFVNALVSSGRTSVLVSEEDEEATFVEPSKRGKYCVVFDPLDGSSNIDCGVSIGTIFGIYTLDHTDEPTTADVLKPGNEMVAAGYCMYGSSCMLVLSTGTGVHGFTLDPSLGEFILTHPDIKIPNKGNIYSVNEGNAQNWDGPTTKYVEKCKFPKDGSPAKSLRYVGSMVADVHRTLLYGGIFLYPADKKSPNGKLRVLYEVFPMSFLMEQAGGQAFTGKKRALDLVPEKIHERSPIFLGSYDDVEEIKALYAEEEKKN

SEQ ID NO: 113 - protein, 1757 aa, Arabidopsis thaliana
MDSQDHKAPGFVDIVKSWIPRKSESSNMSRDFWMPDQSCPVCYECDAQFTVFNRRHHCRLCGRVFCAKCAANSIPSPSDETKDSHEEPERIRVCNYCYKQWEQGIVPPDNGASIISLHFSSSPSARSVASTTSNSSNCTIDSTAGPSPRPKMNPRASRRVSSNMDSEKSEQQNAKSRRSSDHYGHVLDSSDNQVEFFVNSSGRSDGEADDDDDYQSDFAQSYAQGNDYYGAINLDEVDHIYGSHEAHDVGVKIEPNISGFPPDQDLDSLNTETIDKTRHQENGWTDVKEGSPPCEESFEPEVVDFESDGLLWLPPEPENEEDEREAVLSDDDGDEGDRGDWGYLRPSNSFNEKDFHSKDKSSGAMKNVVEGHFRALVAQLLEVDNLPMVNEGDEEGWLDIITSLSWEAATLLKPDTSKSGGMDPGGYVKVKCIPCGRRSESMVVKGVVCKKNVAHRRMTSKIEKPRLLILGGALEYQRISNQLSSFDTLLQQEMDHLKMAVAKIDSHNPDILLVEKSVSRFAQEYLLAKDISLVLNIKRSLLERISRCTGAQIVPSIDQLTSPKLGYCDLFHVEKFVETHVSPCQVAKKMAKTLMFFDGCPKPLGCTILLKGAHEDELKKVKHVIQYGVFAAYHLALETSFLADEGASIHELPLQTPITVALPDKPSMVNRSISTIPGFTVSSAEKSPTTELRGEPHKANGDLTGNFTSSKTHFQGKLDGNDRIDPSERLLHNLDTVYCKPPETITSKDDGLVPTLESRQLSFHVEEPSVQKDQWSVLSGATEQVTDGGYTNDSAVIGNQNFNRQEQMESSKGDFHPSASDHQSILVSLSTRCVWKGSVCERAHLLRIKYYGSFDKPLGRFLRDNLFDQDQCCPSCTMPAEAHIHCYTHRQGSLTISVKKLPELLPGQREGKIWMWHRCLKCPRINGFPPATRRIVMSDAAWGLSFGKFLELSFSNHAAASRVANCGHSLHRDCLRFYGFGRMVACFRYASINIYAVTLPPAKLYFNYENQEWLQKESKEVIKKAEVLFNEVQEALSQISAKTMGAGSKGSTPNKIKLSLEELAGLLEQRKKEYKDSLQQMLNVVKDGQPTIDILLINKLRRLIIFDSYAWDECLAGAANMVRNNYLEAPKNSAPKVMGRNVSLEKLSDEKVKSIPTHVAICNDSLLQDADYETCLNQGKSFADTSGKFAIPEDVGSDRPPDCRMEFDPSEGGKDNFVESSQVVKPAHTESQFQATDLSDTLDAAWIGEQTTSENGIFRPPSRAASTNGTQIPDLRLLGSESELNFKGGPTNDEHTTQVQLPSPSFYYSLNKNYSLNSRKHIMAEDRPVYVSSYRELEWRSGARLLLPLGCNDLVLPVYDDEPTSIIAYALTSSEYKAQMSGSDKSRDRLDSGGSFSLFDSVNLLSLNSLSDLSVDMSRSLSSADEQVSQLLHSSLYLKDLHARISFTDEGPPGKVKYSVTCYYAKEFEALRMICCPSETDFIRSLGRCRKWGAQGGKSNVFFAKSLDDRFIIKQVTKTELESFIKFGPAYFKYLTESISTKSPTSLAKILGIYQVSSKHLKGGKEFKMDVLVMENLLFKRNFTRLYDLKGSTRARYNPDTSGSNTVLLDQNLVEAMPTSPIFVGSKAKRLLERAVWNDTSFLASIHVMDYSLLVGVDEERNELVLGIIDFMRQYTWDKHLETWVKTSGLLGGPKNSTPTVISPQQYKKRFRKAMTAYFLMVPDQWSPAAVVPSNSSSAEVKEEEEKDNPQAVGNKS

SEQ ID NO: 114 - protein, 2150 aa, Arabidopsis thaliana
MTSALGWRFPSTNGNGLAPSDTERNGDMKMHDSEPPTPHSTTKMSLRDRTTSMEDPDGTLASVAQCIEQLRQGSSSAQEREYCLKQLLDLIEMRENAFSAVGSHSQAVPVLVSLLRSGSVGVKIQAATVLGSLCKENELRVKVLLGGCIPPLLGLLKSSSVEGQIAAAKTIYAVSEGGVKDHVGSKIFSTEGVVPVLWDQLRSGNKKGEVDGLLTGALKNLSSTTEGFWSETIRAGGVDVLVKLLTSGQSSTLSNVCFLLACMMMEDASVCSSVLTADITKQLLKLLGSGNEAPVRAEAAAALKSLSAQSKEAKREIANSNGIPVLINATIAPSKEFMQGEYAQALQENAMCALANISGGLSYVISSLGQSLESCSSPAQTADTLGALASALMIYDGKAETTRASDPLVVEQTLLKQFKPRLPFLVQERTIEALASLYGNSILSVKLSNSDAKRLLVGLITMAVNEVQDELVKALLMLCNHEGSLWQALQGREGIQLLISLLGLSSEQQQECAVALLCLLSNENDESKWAITAAGGIPPLVQILETGSAKAREDSATILRNLCNHSEDIRACVESADAVPALLWLLKNGSPNGKEIAAKTLNHLIHKSDTATISQLTALLTSDLPESKIYVLDALKSMLSVVPFNDMLREGSASNDAIETMIKLMSSGKEETQANSASALAAIFQSRKDLRESALALKTLLSAIKLLNVDSERILVESCRCLAAILLSIKENRDVAISAREALPTIVSLANSSVLEVAEQGMCALANLILDSEVSEKVIVEDIILSATRILREGTVSGKTLAAAAIARLLSRRRIDSALTDSVNRAGTVLTLVSLLESADGRSDAISEALDALAIFSRSGANGNVKPAWAVLAESPNSMAPIVSSIVSVANPSLQDKAIEVLSRLCRDQPIVLGNMVNNARDCVSSIAKRVINTRDPKIKIGGAAIIICAAKVDDQKMIENLNETQLCAKFVQALVGILDSVQDQEKDEKDKICICIHPKEKEEDEEEEATENREGSTGATVISGDNLAIWLLSVLSCHDEKSRAVILESEGIELITDRIGNRFLQADNGEDANIWVCALLLAILFQDREITRAHATMKAVPVLSNLVKSEEYADRYFAAQALASLVCNGSRGTLLSVANSGAAAGFISLLGCSDDDIKELLQLSQEFTLVRYPDQVALERLFRVEDIRVGATSRKAIPLLVELLKPIPDRPGAPLLSLNLLTQLAGDCPQNMIVMVESGALEGLSKYLSLGPQDEQEEAATGLLGILFSSAEIRRHESAFGAVSQLVAVLRLGGRGARYSAAKALDSLFTADHIRNAESSRQAVQPLVEILNTGSEREQHAAIAALVRLLSDNPSRALAVADVEMNAVDVLCRILSSNYTMELKGDAAELCYVLFANTRIRSTVAAARCVEPLVSLLVTEFSPAQHSVVRALDKLVDDEQLAELVAAHGAVVPLVGLLYGKNYVLHEAISRALVKLGKDRPACKLEMVKAGVIDCVLDILHEAPDFLCAAFSELLRILTNNATIAKGQSAAKVVEPLFHLLTRLEFGADGQHSALQVLVNILEHPQCRADYTLTPHQVIEPLIPLLESPSPAVQQLAAELLSHLLYEEHLQKDPLTQLAIGPLIHVLGSGIHLLQQRAVKALVSIALTWPNEIAKEGGVSELSKVILQADPSLSNVLWESAASILVIILQFSSEFYLEVPVAVLVRLLRSASENTVVGALNALLVLESDDGTSAESMAESGAIEALLDLLRSHQCEDTAARLLEVLLNNVKIRDSKATKTAILPLSQYLLDPQTQAQQARLLATLALGDLFQNEALARSTDAASACRALVNVLEEQPTEEMKVVAICALQNLVMYSRSNKRAVAEAGGVQVVLDLISSSDPETSVQAAMFVKLLFSNHTVQEYASSETVRAITAAIEKDLWATGTVNDEYLKALNSLFNNFPRLRATEPATLSIPHLVTSLKTGSEATQEAALDALFLLRQAWSACPAEVSRAQSVAAADAIPLLQYLIQSGPPRFQEKAEFLLQCLPGTLVVTIKRGNNMKQSVGNPSVFCKITLGNNPPRQTKVISTGPNPEWDESFSWSFESPPKGQKLHISCKNKSKMGKSSFGKVTIQIDRVVMLGAVAGEYSLLPESKSGPRNLEIEFQWSNK

SEQ ID NO: 115 - protein, 1934 aa, Arabidopsis thaliana
MEASSSGTAELPRSLSRRAPSRATTMMIDRPNEDASAMDSELVPSSLASIAPILRVANEIEKDNPRVAYLCRFHAFEKAHRMDATSSGRGVRQFKTYLLHRLEKEEEETKPQLAKNDPREIQAYYQNFYEKYIKEGETSRKPEEMARLYQIASVLYDVLKTVVPSPKVDYETRRYAEEVERKRDRYEHYNILPLYAVGTKPAIVELPEVKAAFSAVRNVRNLPRRRIHLPSNTPNEMRKARTKLNDILEWLASEFGFQRGNVANQREHIILLLANADIRKRNDEEYDELKPSTVTELMDKTFKSYYSWCKYLHSTSNLKFPDDCDKQQLQLIYISLYLLIWGEASNVRFMPECICYIFHNMANDVYGILFSNVEAVSGETYETEEVIDEESFLRTVITPIYQVIRNEAKRNKGGTASHSQWRNYDDLNEYFWSKKCFKIGWPLDLKADFFLNSDEITPQDERLNQVTYGKSKPKTNFVEVRTFWNLFRDFDRMWIFLVMAFQAMVIVGWHGSGSLGDIFDKDVFKTVLTIFITSAYLTLLQAALDIILNFNAWKNFKFSQILRYLLKFAVAFMWAVLLPIAYSKSVQRPTGVVKFFSTWTGDWKDQSFYTYAVSFYVLPNILAALLFLVPPFRRAMECSDMRPIKVIMWWAQASIKLFFWFLSILPKLYVGRGMHEDMFSLFKYTTFWIMLLISKLAFNYYVEILPLITPTKMIMNLHIGHYQWHEFFPHATNNIGVVIAIWAPIVLVYLMDTQIWYAIFSTLFGGIHGAFSHLGEIRTLGMLRSRFESIPIAFSRTLMPSEDAKRKHADDYVDQKNITNFSQVWNEFIYSMRSEDKISDRDRDLLLVPSSSGDVSVIQWPPFLLASKIPIAVDMAKDFKGKEDAELFRKIKSDSYMYYAVIESYETLKKIIYALLEDEADRRVMNQVFLEVDMSMQQQRFIYEFRMSGLPLLSDKLEKFLSILLSDYEDQGTYKSQLINVFQDVIEIITQDLLVNGHEILERARVHSPDIKNEKKEQRFEKINIHLVRDRCWREKVIRLHLLLSVKESAINVPQNLEARRRITFFANSLFMNMPSAPRIRDMLSFSVLTPYYKEDVLYSEEDLNKENEDGISILFYLQKIYPDEWTNYLDRLKDPKLPEKDKSEFLREWVSYRGQTLARTVRGMMYYRQALELQCYQEVAGEQAEFSVFRAMASNDENQKAFLERARALADLKFTYVVSCQVYGNQKKSGDIHNRSCYTNILQLMLKYPSLRVAYVDEREETADAKSPKVFYSVLLKGGDKFDEEIYRIKLPGPPAEIGEGKPENQNHAIIFTRGEALQTIDMNQDNYFEEAFKLRNVLEEFNKERVGRRKPTILGLREHIFTGSVSSLAWFMSNQESSFVTIGQRILANPLRVRFHYGHPDIFDRIFHITRGGVSKASKVINLSEDIFGGFNSTLRGGYVTHHEYIQVGKGRDVGLNPISIFEAKVANGNGEQTLSRDVYRLGHRFDFYRMLSFYFTTIGFYFSSMLTVLTVYAFLYGRMYMVMSGLEKEILRLASPNQLEALEQALATQSIFQLGFLMVLPMVMEIGLEHGFRSAIVDFFIMQLQLASVFFTFQLGTKSHYYGRTILHGGSKYRPTGRGFVVFHAKFAENYRLYSRSHFVKGLELLLLLVVYQIYGHSYRSSNLYLYITVSMWFMVGSWLFAPFIFNPSGFEWQKTVDDWTDWKRWLGDRGGIGIPVEKSWESWWNVEQEHLKHTSIRGRILEITLALRFFIYQYGIVYQLNISQRSKSFLVYGLSWVVLLTSLLVLKMVSMGRRRFGTDFQLMFRILKALLFLGFLSVMTILFVVFKLTLTDLSASVLAFLPTGWAILLIGQVLRSPIKALGVWDSVKELGRAYENIMGLVIFAPIAVLSWFPIVSEFQARLLFNQAFSRGLQISMILAGRKDKATSSHK

SEQ ID NO: 116 - protein, 146 aa, Arabidopsis thaliana
MAWDLFLWIVSFFVSLALVASVFYQVICLTDLEADYLNPFETSTRINRLVIPEFILQGSLCLLFLLTWHWVFFLVAVPVTVYHAMLYKERRYLIDVTEVFRGISFEKKLRYTKLGFYVFLFIMVVFRLTLSAVYSFTEDDDLLHLF

SEQ ID NO: 117 - protein, 161 aa, Arabidopsis thaliana
MNSVCISSCINDAHDPRVPVRPVRASYVNLYKWPESDAEFVRSVRRGGGLPAARVVDSISCRQMYLRSYTFSREDDESKSEKVSSGTQTSCLGRVKGTASSRRKSKEENGIIIVESTKPRRRGEKRRVSRKNKQEQACSVILRIFRRLLSCAATVDVVDPN

SEQ ID NO: 118 - protein, 136 aa, Arabidopsis thaliana
MSVSLFTAFTVLSLCLHTSTSEFQLSTISAAPSFLPEAPSSFSASTPAMSPDTSPLFPTPGSSEMSPSPSESSIMPTIPSSLSPPNPDAVTPDPLLEVSPVGSPLPASSSVCLVSSQLSSLLLVLLMLLLAFCSFF

SEQ ID NO: 119 - protein, 182 aa, Arabidopsis thaliana
MRKLKYHEKKLIKKVNFLEWKREGNHRENEITYRYHMGSRDDYKKYSGLCRMVQKLTNIMKQMDPADPFRIQMTDMLLEKLYNMGVIPTRKSLTLTERLSVSSFCRRRLSTVLVHLKFAEHHKEAVTYIEQGHVRVGPETITDPAFLVTRNMEDFITWVDSSKIKRKVLEYNDTLDDYDMLA

SEQ ID NO: 120 - protein, 272 aa, Arabidopsis thaliana
MQVISPSSPAPRFAGKERFSEVYGELNDDFGSKLKISSKEEENRDDDSWWNQNGTDKDDEGREEDFSFASVNADNSPITADEAFEDGQIRPVYPLFNRNIFFDDPEEKTLRSPLKKLFVESTTTEEEEEESDTVGPYCSWTNRTVEQASPETCRKSNSTGFSKLWRFRDLVLRSNSDGKDAFVFLSNGSSSTSSTSSTAARLSGVVKSSEKGKEKTKTDKKKDKMRTKSAHEKLYMRNRAMREEGKRRSYLPYKHVGFFTNVNGLTRNVHPY

SEQ ID NO: 121 - protein, 1607 aa, Arabidopsis thaliana
MAQKPEEQLKELGSKLDLAPVSKDSLLKLLKEAAVCLSELEQSPPPAVLKSIQPFLDAVIKPEILNHQDKDVKLLVASCVSEITRITAPEAPYSDNIMKDIFQLIVSAFAGLNDVSGPSFGRRVLILETVAKYRSCVVMLDLECDDLVKEVFTTFLDVARDDHPEIVFSSMQNIMIVLLEESEDVQEHLLLILLSKLGRNRSDVRDAARRLAMKVIEHCAPKVESDIKQFLISSMSGDSRFSSSQIDYHEVIYDLYRCAPQALSGVAPYLTGELLADKLETRLKVVGLVGELFSLPGRVISEEFDSIFLEFLKRLTDRVVEVRMAILDHIKDCLLSDPLRAEASQIISALCDRLLDYDENIRKQVVAVICDVSVSALTSIPVDTMKLVAERLRDKAILVKTYTMERLTELFRVYCLRCADGKVDTGDFNWIPGKILRCLYDKDFRSDTIEYILCSSLFPSDFSVRDKVKHWIQIFSGFDKVETKAFEKILEQRQRIQQEMQRYLSIKQTQQTADAPEIQKKILFGFRVMSRAFSDPPKTEQNFLILDQLKDANIWKILTNLLDPNTSITQASRIRDDMLKILSEKHSLYDFLSTLSIKCSYLLFSKEYVKEILAEVSVRKSSKNTLGIQPCMDFLGLLACFCPSLFDGAEEELISFLKDDDEMMKEGTLKILAKAGGTIRENLIVLASSVDLLLERICVEGNRKQAKYAVHALASITKDDGLKSLSVLYKRLVDMLEDKRYQPAVLQCLGCIAQIAMPVYETRESEVVEFIRSKILKLKSETVDDKKLSWDDKSEICQLKIYGIKTLVKSYLPFKDAQLRAGVDDLLGILKNILSFGEVSEDLESSSVDKAHLRLAAAKAVLRLSRHWDDKIPIEIFHLTLKTPEIPFPTAKKIFLGKVHQYVKDRVLEMKYACSFLFDITGSNVLESEEDKHNLADIIQHSYQTKVRKISAQTDANSVTLYPHHILPYLVHALAHHSCPDVEKCKDVKEYEMIYRQLYLIISMLLHKEEDGKTEDIDKEREYVPTIILIFHSIKQSEDVTDATKSKNSHAICELGLSIINHLTQKEPDLQGEITPVSLPPTLYKPSEKVEGDKSQVGEEKLWLADETVLLHFRALKLESHADASVIPQTSENEVMIDGESDGNEIPLGKIVERLRAQGTKTRKGKKNKSVPAEDENGKNDVDVLKMVREINLDHLQMLDKFESSNGHKHSPSERAEICQRDQKGNKRNVGDATSVVSVPKRRRSSSGHSPYKFSNSGPKVQLKASEDELHLESDMDKNVSLDSHDENSDQEKMLESISPRKRKKSLSSKLKITESDWALTDVERQSRSAGGGDSKLKSASGSMKKRKNVSGLAKCSTKENKLVNDELIGCRIEVWWPMDKRFYEGTVKSYDSTKQRHVILYEDGDVEVLNLKKEQWELIDTGGKTAKKSRTSKGNSKKKRSSGSKPKNPDGVQRDEDPVTTTPKGKRTPKKNLKQLHPKDTPKSLSLEHEKVESRNKKRRSSALPIETEYSGEAGEEKSESEGKSLKEGEDDEEVVNKEEDLQEAKTESSGDAEGKEAEHDDSDTEGKQENNEMEREAEENAETSDNETLGAWKSKVGKSISRTAI

SEQ ID NO: 122 - protein, 542 aa, Arabidopsis thaliana
MESQKQEDNEYIFRSLYPSVPIPDKLTLPEFVLQGVEEYTENVAFVEAVTGKAVTYGDVVRDTKRLAKALTSLGLRKGQVMVVVLPNVAEYGIIALGIMSAGGVFSGANPTALVSEIKKQVEASGARGIITDATNYEKVKSLGLPVIVLGEEKIEGAVNWKDLLEAGDKCGDTDNEEILQTDLCALPFSSGTTGLQKGVMLTHRNLIANLCSTLFGVRSEMIGQIVTLGLIPFFHIYGIVGICCATMKNKGKVVAMSRYDLRIFLNALIAHEVSFAPIVPPIILNLVKNPIVDEFDLSKLKLQSVMTAAAPLAPELLTAFEAKFPNVQVQEAYGLTEHSCITLTHGDPEKGQGIAKRNSVGFILPNLEVKFIDPDTGRSLPKNTSGELCVRSQCVMQGYFMNKEETDKTIDEQGWLHTGDIGYIDDDGDIFIVDRIKELIKYKGFQVAPAELEAILLTHPSVEDVAVVPLPDEEAGEIPAACVVINPKATEKEEDILNFVAANVAHYKKVRAVHFVDSIPKSLSGKIMRRLLRDKILSINKK

SEQ ID NO: 123 - protein, 225 aa, Arabidopsis thaliana
MQSIRGSTRLLQRHRFSISNTLRFTSSSSCGSWSENESRKLGFDSCPSSRAATYLISSLKNAGFSSSAIPKQNFTYASRCFSTTGDSSVQGSPESDCVVPQRIKFKRLDKTAKHIMQIVDKEAVEEVRSLREIPEIKPGYIVQLKVEVPENKRRVSIVKGVVIARRNAGLNSTFRIRRLVAGVGVESMFPLYSPNLREIKVVDKKKVRRAKLYYLRDKVNALKKH

SEQ ID NO: 124 - protein, 509 aa, Arabidopsis thaliana
MGDDKKDQKQLSSYLKAKNFSCDSHFSFYWLMSRLIFLILAILFSLQFVFYPLNFISSSSQPLIKFSVSPVVSGSGSVHEPDQTELKHVVFGIAASAKFWKHRKDYVKLWWKPNGEMNGVVWLDQHINQNDNVSKTLPPIRISSDTSRFQYRYPKGLRSAIRITRIVSETVRLLNGTELEKNVRWIVMGDDDTVFFPENLVKVLRKYDHNQFYYIGSSSESHIQNLKFSYGMAYGGGGFAISYPLAKALEKMQDRCIQRYSELYGSDDRIHACMSELGVPLTKEVGFHQIDLYGKLLGLLSAHPLAPLVSIHHLDLVDPVFPNMGRVNAMRRFMVPAKLDSPSLAQQSICYDADHRWTVSVSWGYTVQIIRGVLSAREMVIPTRTFIDWYKQADERSYAFNTRPIAKSACQRPRVYYLSNALPDLALRRTASEYVRWYDMWEPECDWDMSDPSEFERVIVYKKPDPDRWNKHRAPRRDCCRVLPTTKNGTMVIDVGACKDDEFAEFLVK

SEQ ID NO: 125 - protein, 331 aa, Arabidopsis thaliana
MGSSQGSTLSADVMSLVDTLPVLAKTLIAGGAAGAIAKTAVAPLERIKILLQTRTNDFKTLGVSQSLKKVLQFDGPLGFYKGNGASVIRIIPYAALHYMTYEVYRDWILEKNLPLGSGPIVDLVAGSAAGGTAVLCTYPLDLARTKLAYQVSDTRQSLRGGANGFYRQPTYSGIKEVLAMAYKEGGPRGLYRGIGPTLIGILPYAGLKFYIYEELKRHVPEEHQNSVRMHLPCGALAGLFGQTITYPLDVVRRQMQVENLQPMTSEGNNKRYKNTFDGLNTIVRTQGWKQLFAGLSINYIKIVPSVAIGFTVYESMKSWMRIPPRERSKPA

SEQ ID NO: 126 - protein, 333 aa, Arabidopsis thaliana
MDPSCANSVNGFYSFLNRSMEDLERVYLSNNFMSVHFLQRALCLLRTSHSHLTLLVQKLQLPVGDKWLDEYMDESSKLWEACLVIKSAVSSVENFSSAGISIASTLDRRLSPQLSRQVIRAISGCRREAIGIEEENRALMENRVQRFPFWSEQTSATAMESSTKLQNGFSGFRGVLYATRNMSSLLLMVLMNGLVYCFPGDAATQTQTQITQTQSQVGGFAGAMGRLQQRVAAEVGRMGIRKGILMHEYRRSKAALEELKAELERRFCGGGGGGGEREEEEEDERELRERVENLKGYFGNLRNGTESIVAQIDDFFDEIVEGRKKLLDFCSHR

SEQ ID NO: 127 - protein, 285 aa, Arabidopsis thaliana
MFLLYRRLPSFARTTTTTLLCKSMEPAITATSSSSFGGGSSRLAALAQQLRQYKPPPSSSFDDSEEMQTDQETAGKVVSQVGFQESIAPLSKDPDRFKPKRAAVLICLFEGDDGDLRVILTKRSSKLSTHSGEVSLPGGKAEEDDKDDGMTATREAEEEIGLDPSLVDVVTSLEPFLSKHLLRVIPVIGILRDKNKFNPIPNPGEVEAVFDAPLEMFLKDENRRSEEREWMGEKYLIHYFDYRTGDKDYMIWGLTAGILIRAASVTYERPPAFIEQCPKFKYPKM

SEQ ID NO: 128 - protein, 481 aa, Arabidopsis thaliana
MACRAKELVSLILYKICNPKRSDSKIEEHVEEVEDLKAEAELFRSGSKIEKHVEELEDLKAEAELFRLKAISGTEELKAVADVKRLRTILENNSGTSEECKGEMLKEDLFLPSDLVRLILSRLSFKDNIRSSTVCKAWGDIAASVRVKSRRCWLLYHDAFQDKGVSYGFFDPVEKKKTKEMNLPELSKSSGILYSKDGWLLMNDSLSLIADMYFFNPFTRERIDLPRNRIMESVHTNFAFSCAPTKKSCLVFGINNISSSVAIKISTWRPGATTWLHEDFPNLFPSYFRRLGNILYSDGLFYTASETALGVFDPTARTWNVLPVQPIPMAPRSIRWMTEYEGHIFLVDASSLEPMVYRLNRLESVWEKKETLDGSSIFLSDGSCVMTYGLTGSMSNILYFWSRFINERRSTKSPCPFSRNHPYKYSLYSRSSCEDPEGYYFEYLTWGQKVGVWIEPPHSISIYDYSILDPSEAVNTEYVFI

SEQ ID NO: 129 - protein, 160 aa, Arabidopsis thaliana
MYLGLIRINPLISLNSVSGNVIDTQKQVLSLIRDFTLKDLVEISGFERFYYSIPGDTGELSLNDFTIQSLEARISLLQDEVSTNGIEDDALKRSVYKLNGRIDQGEKFHKTIDLSVGSDETTGITANNKAFVDGSGADSEAIKGMLSDSLSLLRYTVSRW

SEQ ID NO: 130 - protein, 1327 aa, Arabidopsis thaliana
MASRTKTGLMETPRSKPSPPPPRLSKLSASKSDSNSASPVPNTRLSLDRSPPTKVHSRLVKGTELQTQLNQIQEDLKKADEQIELLKKDKAKAIDDLKESEKLVEEANEKLKEALAAQKRAEESFEVEKFRAVELEQAGLEAVQKKDVTSKNELESIRSQHALDISALLSTTEELQRVKHELSMTADAKNKALSHAEEATKIAEIHAEKAEILASELGRLKALLGSKEEKEAIEGNEIVSKLKSEIELLRGELEKVSILESSLKEQEGLVEQLKVDLEAAKMAESCTNSSVEEWKNKVHELEKEVEESNRSKSSASESMESVMKQLAELNHVLHETKSDNAAQKEKIELLEKTIEAQRTDLEEYGRQVCIAKEEASKLENLVESIKSELEISQEEKTRALDNEKAATSNIQNLLDQRTELSIELERCKVEEEKSKKDMESLTLALQEASTESSEAKATLLVCQEELKNCESQVDSLKLASKETNEKYEKMLEDARNEIDSLKSTVDSIQNEFENSKAGWEQKELHLMGCVKKSEEENSSSQEEVSRLVNLLKESEEDACARKEEEASLKNNLKVAEGEVKYLQETLGEAKAESMKLKESLLDKEEDLKNVTAEISSLREWEGSVLEKIEELSKVKESLVDKETKLQSITQEAEELKGREAAHMKQIEELSTANASLVDEATKLQSIVQESEDLKEKEAGYLKKIEELSVANESLADNVTDLQSIVQESKDLKEREVAYLKKIEELSVANESLVDKETKLQHIDQEAEELRGREASHLKKIEELSKENENLVDNVANMQNIAEESKDLREREVAYLKKIDELSTANGTLADNVTNLQNISEENKELRERETTLLKKAEELSELNESLVDKASKLQTVVQENEELRERETAYLKKIEELSKLHEILSDQETKLQISNHEKEELKERETAYLKKIEELSKVQEDLLNKENELHGMVVEIEDLRSKDSLAQKKIEELSNFNASLLIKENELQAVVCENEELKSKQVSTLKTIDELSDLKQSLIHKEKELQAAIVENEKLKAEAALSLQRIEELTNLKQTLIDKQNELQGVFHENEELKAKEASSLKKIDELLHLEQSWLEKESEFQRVTQENLELKTQDALAAKKIEELSKLKESLLEKETELKCREAAALEKMEEPSKHGNSELNSIGKDYDLVQFSEVNGASNGDEKTKTDHYQQRSREHMIQESPMEAIDKHLMGERAAIHKVAHRVEGERNVEKESEFKMWDSYKIEKSEVSPERETELDSVEEEVDSKAESSENMDQYSNGFSLTDHTEDSGNLLLKEQHMKKKKPLLRKFGNLLKKKSTSSSSQK

SEQ ID NO: 131 - protein, 504 aa, Arabidopsis thaliana
MGLCYSVDRTTGKEPGEASSTATTAETVEERSGSGRWRRPRDLKGGGDIEGIPQVLGRLVSNGSSKIACLYTQQGKKGTNQDAMLVFENFCSRDDTVFCGVFDGHGPFGHMVAKKVRDTLPFTLLTQLKMTSESDQSSLVGANGFQIKCTEEEEVQTTESEQVQKTESVTTMDEQWCELNPNVNNDELPEMYLPLKHAMLKSCQQIDKELKMHPTIDCFCSGTTSVTLIKQGEDLVVGNIGDSRAVLATRDEDNALLAVQLTIDLKPDLPGESARIQKCKGRVFALQDEPEVARVWLPNSDSPGLAMARAFGDFCLKDYGLISVPDINYRRLTERDQFIILASDGVWDVLSNKEAVDIVASAPSRSTAARALVDTAVRSWRIKYPTSKNDDCTVVCLFLQDSSVAMEVSTNVKKDSPKEESIESVTNSTSKEEDEIVPVKDEKIPESCGIESKMMTMTLAECISVAQDDEEWSALEGLTRVNSLLSIPRFLSGELRSTSWRKWL

SEQ ID NO: 132 - protein, 608 aa, Arabidopsis thaliana
MLEIGSPNALFFRTNTTCNNLLRELQKIWVEIGETETEKDRMLMELERECLQIYQRKVDEAANSKAKLHQSVASIEAEVASLMAALGVLNINSPIKLDKGSKSLKEKLAAVTPLVEELRIQKEERMKQFSDIKAQIEKISGEISGYSDHLNKAMNISLTLEEQDLTLRNLNEYQTHLRTLQKEKSDRLNKVLGYVNEVHALCGVLGVDFSQTVSAVHPSLHRTDQEQSTNISDSTLEGLEHMIQKLKTERKSRFQKLKDVVASLFELWNLMDTPQEDRTKFGKVTYVVRSSEANITEPGILSTETIEQVSTEVDSLSKLKASRMKELVMKRRSELEDLCRLTHIQPDTSTSAEKSTALIDSGLVDPSELLANIEMQINKIKDEAQSRKDIMDRIDRWLSACEEENWLEEYNLDENRYSAGRGGHVNLKRAERARVTINKIPGMVDTLIKKTLVWEEDMQKSFLYDGVRLVNILEDYKLTRKQQEEEKKRYRDQKKRQDLLLTQRESIYGSKPSPRRSSSFRKPNGFNISNGNGSVPPTPRRGSVGTTTPDVLLTPRSYSGHHRQNGYFKEVRRLSTTPLNYVAMQKEDTVSTTYTSIYSSEPDSPLQG

SEQ ID NO: 133 - protein, 1088 aa, Arabidopsis thaliana
MDSDASAKENTQDLSDYKGMIETGGEGSVRDELQEPGLMVKQREVKGVEASYAVKCANTTVKRKMDQHKEAMLGKKRNRQTRFLNLEDVKQAGTVNTSTPRRQNFAQAVPTRSSAVNPPAEHGGESQSQSHQNLKSVDFPSTGGIHSESAEQKTESNGESYSGLLGKPRRLNRDEEPSAEGMGTSVSRQASWKQPANIRQPKSGHSSSRKVSYSQRSFKKPATSSTQYQDTSVERLIREVTNEKFWRHPEDTELRSVPERFESMEEYVRVFEPLLFEECRAQLYSTWVELAEANTYVKVRIKSIERRERGWYDVILNSLNGCKWAFKEGDVAVLSTPLPESDHEDAGRVAGTVRRHIPVDTRDPRGATLHFYVGNSGGTGSKIDDSHILRKLKPQDIWHLTVLGSLATTQREYVALHAFSRLNPQMQNAILNPSPEQFPSYEEQTPATPDCFTTSFVDHLHRSFNAPQLAAIHWAAMHTAAGTSSGVKKQEPWPFTLVQGPPGTGKTHTVWGMLNVIHLVQYQQYYTSLLKKLAPETYNQANECSSSDNILSGSIDEVLQNMDHNLFRTLPKLCAKPRMLVCAPSNAATDELLSRVLDRGFIDGEMRVYRPDVARVGVDSQSRAAQAVSVERRSDQLLAISRDEILRHMRNLRLQETQISQNIAGLKRELNAAAFATRSQGSVGVDPEVLISRDQKRDALLQHLAAVVEARDKVLVEISRLLIVEGKFRAGNNFNLEEARASLEASFANEAEIVFTTVSSSGRKLFSRLTHGFDMVVIDEAAQASEVGVLPPLALGAARCVLVGDPQQLPATVISKAAGTLLYSRSLFERFQLAGCPTLLLTVQYRMHPQIRDFPSRYFYQGRLKDSESISSAPDEIYYKDPVLRPYLFFNISHGRESHRGGSVSYENVDEARFCVGVYMHLQKTLKSLGASKVSVGVITPYKLQLKCLKHEFGNALGQDELKEIYINTVDAFQGQERDVIIMSCVRASGHGVGFVSDIRRMNVALTRARRALWVMGNASALMKSEDWAALISDARGRNCFMEMDSLPLDFPIPKVSSYNPMAPNNGLITSKLYPSDAPIIGLHTKLR

SEQ ID NO: 134 - protein, 525 aa, Arabidopsis thaliana
MANSKYEYVKSFEVEDEVMFPNLIIIRIDGRDFSRFSQVHKFEKPNDETSLNLMNSCASSVLVEYPDIVFAYGYSDEYSFVFKKASRFYQRRASKILSLVASFFAAVYVTKWKEFFPHTKLEYAPSFASKVVSCASVEVLQAYLAWRQHDCHISNQYDTCLWMLVKSGKTLSETQEILKDTQKQQRNELLFQQFGINYKMLPVLFRQGSCLFKTKLEETVKHDENGKPVKRLRRRETLVHSENVAGRSFWNEHSSLHKDLGHFAKDIGKIEPDYVKSFQFESRLLPLTWVVVRIDGCHFHRFSEVHEFEKPNDEQALKLMNSCAVAVLEEFQDIAFAYGVSDEFSFVLKNKSELYKRQSSKIISAVVSFFTSTYMMRWGDFFPHKKLKYPPSFDGRAVCYPTSDILLDYLAWRQVDCHINNQYNTCFWMLVKSGKSKIQAQDYLKGTQTREKNELLSQQFGIEYNSLPVIFRMGSSVFRLKTQEGVTEENGEVSGKQVEAEVGVDYSNIIDQCFWQQHPHILSFS

SEQ ID NO: 135 - protein, 1007 aa, Arabidopsis thaliana
MKEDLVPESNSSVWQSPVKRLAVDGECGEAGDRSRTSCKRIKTTQVNGFIVYTRTRKTKFTKLHEQEDENAGLSNHLEESKPTSGVTSGFGGDMCRSSSVGETNVSGSSCVKNTLVESSSGKVVVIERLVTGGLAESPAVETDSSSLVDVVIDDINFVELLHEAIPVEILSEGSLDFEVKRLGTKVRTMGKSYSVSEKKKHGSFKRTAQIYKSIVRMKKVNNLVPENVEVLAEPDFGREGLDEQSHSVSLADKSILIRSRPETVRDLFETGLLDGLSVVYMGTVKSQAFPLRGIIRDGGILCSCSSCDWANVISTSKFEIHACKQYRRASQYICFENGKSLLDVLNISRNTPLHALEATILDAVDYASKEKRFTCKRCKGPFPFSSLGHRGFLCKSCSEVETSQASLAATRTSTSAPACITSPVKSRLKITRKPSESTSISPVFMSSLGNSTRKITRKALRQALVGKAYLSASTNVSSQKKCRSKFKKMLTQHSVTPKALKSVSLSVSSKKRSYRLARKDQGLHKLVFDRGGLPEGTELGYYARGQKLLGGYKMGAGIYCYCCKCEVSPSLFEAHAGWASRRKPYFYIYTSNGVSLHEWATTFSHGRKYSANDNNDLCVICADGGNLLLCDSCPRAFHIECVSLPSIPRGNWHCKYCENKFTSEIAGEYNVNSSAVGQLEGVDPVDQLAGRCIRVVKNMEAETNGCVLCSGSDFCRSGFGPRTIIICDQCEKEYHIGCLSSQNIVDLKELPKGNWFCSMDCTRINSTLQKLLLGGAEKLSDSSLGIIQTKQERNDVYSISDLDIRWRLISGKVTSPESRMLLSQALAIFHDCFDPIVDPLSGSNLIPRMVYGKTMQGQDYGGICCAVLTVNATVVSAGLLRVFGREVAELPLVATRMCSREKGYFQLLFSCIEKLLSSLNVESIVVPAAEEAEPLWMNKFGFRKLAPEQLSKYIKICYQMVRFKGASMLQKPVDSHQIIDKTIETGASLEENFDLKQANELYVHPLC

SEQ ID NO: 136 - protein, 1592 aa, Arabidopsis thaliana
MTTPITGKNSPVTGKEEGELSTSDDEVQPMQTSTRSPLTEHISANTNIQRRQAGNGGSFIKPSDATPTKLTNPGGRIFETKQAIAAIHGKKFPVRGNNSNLVINFSDDDSGSESDCKGRTQTSKIQPKGTISGNRNPSTFSQTKLKGPRQIDIRAITKKALSTSTFSHAATSKVSNLSFAKEMKSNKYIHSSERTVSKDAQRPEQIVESNSNKLQDLKQQIALRESELKLKAAQPKKDAVNPKITPARRVSIISDDTRHLEPNEPPKKRLKVSGIDTSQPVIDYRVAASAAAPMNAPDIRKSLLPGVNANSSCKHLGSKSDEIVPPVIPQHTVEGNTSSSVLQKSTGKVNHYEGGRELETMKNVDRSVSSEQLLKIVNGNHQPCSNNSGLYNIPGSTTVPGHSQLDMLSLTNLEESLDKELEEAQERKRLFEIEERNALKVYRKAQRSLIEANARCAELYSKREILSAHYGSLIVRDSRLLWPSIHGENPETGFHFLNNSTGSIDLATKTDIAQHSQLESNHKYNSEYVGSHPPPHSRSGQNLGYSDLGASTSDGLPCGNKQTASRLCSPSSDANILPDDESFPVDHESTEGNPGHQKENIDQTLGNQNALLLEASLRSKLFDRLGMRAESRGGTCFNEETVIDRGDERDFGSEGTQRDNGSPFSEIYLHNDSLEPGANKLQGSPSEAPVERRSIEENSLNYQLSIDMESHRSSPENALLSSVALSGPLFRSTIYHLKVPGSSITSLGPEYILQNKTYSLYSDKRQCRSLTETIVYEKKIGFYTCNLKVDPSWPLCMYELRGRCNNDECSWQHFKDFSDDSLHQSLHDPDGRVGSSSHQKTHNSSKGSQILDSVFSPTYLVSLDTMKVDSWSYESVLAQRHGQIWCKHFSACLASSNSLYRNVPAKENEGRIVVLGNSKTYSSYFRIKHSLMNILKQGSDAAVEPMEMALIIFFREVEQSEGLIQALSLLSQGLEGDPTSEILWAVYLLIYHAYEGSDGKDMFSYGVKHSSRSYVIWLMYINSRGQLNDQLIAYDTALSALCNHASGSIDRNHASACILDVLLQMFNLLCISGNVSKAIQRISKLQAPAAVSDDPDFSLMSHILTCLTYSDKCVFWVCCVYLVIYRKLPDSIIRRLEMEKELLEIEWPTVNLDGDLKQMALRLFDKGMRSVEHGTNNGIQKRPAGLFALNYALFMIAVDELESRRDILKASVQLYPTCLELKLLAVRMQSNELKDMFSSGFEELLKQEAKEASCIQCIWNQYAEYALEGGSYDLARELMSRWYGSVWDVLSHKYKTVRGNEEEGDDNMLESALSDLNVASDQVDVMFGYLNLSLHNLLQSNWTEARLAIDQALKATAPEHFMHCLREHAVFQLINELQATGEFSINLQMRLLNSYLDRASSLPVKEPLSWKFISNSAEKPRVRKLVTNLLAPVSSELFVVNVVLEAWHGPSLVPEKLSKQKELVDFVETILGLVPSNYPLALSVSKLLRKEEKQSDSGSSSGIHFWAGLNLASTISCAIPVAPEYIWVEAGEIVSDINGFKTRAERFLKKALSVYPMSVKLWRCYWSLCKSIEERRGIEIEEAARKKGITLA

SEQ ID NO: 137 - protein, 625 aa, Arabidopsis thaliana
MLVCGKGFLKCRAPGVPFFCDKRKSFFTKTKRGFHSLPLGTGVRVYFNNNLRYSSNSIEVVEKAAINMGSKEDKADNPALSSYDDAMEALSTLISRRNRGDRTPTKGNRDKLEQVVTYLKILDLEDKIKELKVIHVAGTKGKGSTCVFSEAILRNCGFRTGMFTSPHLIDVRERFRIDGLDISEEKFLQYFWECWKLLKEKAVDGLTMPPLFQFLTVLAFKIFVCEKVDVAVIEVGLGGKLDSTNVIQKPVVCGIASLGMDHMDILGNTLADIAFHKAGIFKPQIPAFTVPQLSEAMDVLQKTANNLEVPLEVVAPLEPKKLDGVTLGLSGDHQLVNAGLAVSLSRCWLQRTGNWKKIFPNESKETEIPVAFCRGLATARLHGRAQVVHDVVSDPQDSSDSMETPCGDLIFYLDGAHSPESMEACGRWFSSAVRGDKSLSTAVNGYMRHGEYGTDLNRVSKQILLFNCMEVRDPQVLLPKLVTTCASSGTHFSRALFVPSMSTYNKVISGASAIPSDTRRKDLTWQFRLQRLWEKSIQGTDAGLDHTLKPDGITALPPHDFLCGDAPQCGGPAGTPVTSSAVMPSLPLTINWLRDCVRRNPSLKLEVLVTGSLHLVGDVLRLLKR

SEQ ID NO: 138 - protein, 636 aa, Arabidopsis thaliana
MGKSSKKSVTEVETPASMTKPLKKGKRDAEEDLDMQVTKKQKKELIDVVQKEKAEKTVPKKVESSSSDASDSDEEEKTKETPSKLKDESSSEEEDDSSSDEEIAPAKKRPEPIKKAKVESSSSDDDSTSDEETAPVKKQPAVLEKAKVESSSSDDDSSSDEETVPVKKQPAVLEKAKIESSSSDDDSSSDEETVPMKKQTAVLEKAKAESSSSDDGSSSDEEPTPAKKEPIVVKKDSSDESSSDEETPVVKKKPTTVVKDAKAESSSSEEESSSDDEPTPAKKPTVVKNAKPAAKDSSSSEEDSDEEESDDEKPPTKKAKVSSKTSKQESSSDESSDESDKEESKDEKVTPKKKDSDVEMVDAEQKSNAKQPKTPTNQTQGGSKTLFAGNLSYQIARSDIENFFKEAGEVVDVRLSSFDDGSFKGYGHIEFASPEEAQKALEMNGKLLLGRDVRLDLANERGTPRNSNPGRKGEGSQSRTIYVRGFSSSLGEDEIKKELRSHFSKCGEVTRVHVPTDRETGASRGFAYIDLTSGFDEALQLSGSEIGGGNIHVEESRPRDSDEGRSSNRAPARGAPRGRHSDRAPRGGRFSDRAPRGRHSDRGAPRGRFSTRGRGPSKPSVMESSKGTKTVFNDEE

SEQ ID NO: 139 - protein, 823 aa, Arabidopsis thaliana
MSSRGRERMMMKEDGRGRNPPSRHLWVGNLPHGILERELADRFLRFGELESLAFQPGRSYAFVNFNHDEDAFAAIESLQGFPLSGNPLRIEFAKAEKSSTGSRTDDIYRHDEQRSAARGSSFVQRDSRMRYESPDTYSKSKMNDRNAEPSEVLYIGFPASLKVDDALLRNVFSSFGEITKVTVFPGRSYAFVQFRNLMAACKAKESLQGKLFGNPRVHICFAKSEPSSSGSGRGPSGRSLSPPYRSVDRLGSSEGYLQDRNYGSISRIPSVREPHYIEDRDLEDSEGYIFNRKRDSSSDGGPAYGRSRSTHRFPQDMHEYHGSPGEMGTSFRDNPHRFQTRSSEYEEPWDLPEDDYYYQEIKRLKTRSSQPERQLPGHQLSGIEQERRPFSRASADFSPKDAFERNYEAGQLRYNQTVEQPLNLAIRNGDKSSLREPHEELMGGYPLPSVVPERKRYTPELNRPSLKDWNWEGTIAKGGNPICRAKCFPVGKVMDMMLPEFLDCTARTGLDMLAKHYYQSSKAWVVFFVPGSDADIVFYDEFMHYLEEKQRAAVSKLDDTTTLFLVPPSDFSEKVLKVPGKLSISGVILRLECGGSGSGGPVQQQGERKDTDLLTYYGETSYSEASGAFPDVGNPRIPGPTAFLRSAGRDNQSASMDPYVEDKHDQLSHRYSGSDWPPRDTNPRSSPFIDHTVQKHSGFVPGKQQNADLSRYHDTETPVPAGFQPEQLTHLASSLPRQQQQVQNTPNQPERYAPEGRASFSHLQHAQTPSIPQLVTPQNQNVQIQSSNSQQQEETEANPQKRLQATLQLAAALLQQIQQAKPS

SEQ ID NO: 140 - protein, 493 aa, Arabidopsis thaliana
MQSLSQLGPSEIFLVARREKPSTRAQLWFTGRLSFRQETNGIRLKNRVEFSPRPVPPNLIAAEKEEAKAVLTLFFKKQGLSNSLSSRLINKSDLFIDHLVSRLHSVHKARYLVGRELTTLEIRDSLIPYLEQLHEEHGDLLAELVVSFPDPPAEPRLVASSPVSVLPPRGDTDSAADTRKLRAVSRVSELDTEGALRPQTLYLLDLGLNLEQIKTITRKFAAFPYYSLDGKIKPVVEFLLDLGIPKSDIPTILCKRPQICGISLTDNLKPTMAFLETLGIDKNQWAKIISRFPAILTYSRQKLTSTVEFLSQTGLTEEQIGRILTRCPNIMSYSVEDKLRPTMEYFRSLNVDVAVLLHRCPQTFGLSIESNLKPVTEFFLEKGFGLDEIGIMISRYGALYTFSLKENVMPKWDYFQTMDYPKSELVKFPQFFGYSLQERIKPRYELVQRSGVRLLLNQVLSLSGIEFEKVVKKKMMKLVSNNVIAEQSSGGLL

SEQ ID NO: 141 - protein, 190 aa, Arabidopsis thaliana
MEHEGKNNMNGMEMEKGKRELGSRKGVELTMRVLALILTMAAATVLGVAKQTKVVSIKLIPTLPPLDITTTAKASYLSAFVYNISVNAIACGYTAISIAILMISRGRRSKKLLMVVLLGDLVMVALLFSGTGAASAIGLMGLHGNKHVMWKKVCGVFGKFCHRAAPSLPLTLLAAVVFMFLVVLDAIKLP

SEQ ID NO: 142 - protein, 306 aa, Arabidopsis thaliana
MEKDDNSDKVCLSVKEKYTSEQPEEMVTNLKASVRELSVKVKEQNQRKCDAKDKLQQLRERISKEVVDVSVQELIPLLRSLKEFVKEESEVRSRCNVKRSALEDAVHDLEERAGKGLDGEIQEEDLDGLLVVSLDNLTSAKKELGATLREIVSLKRQIDDVPCQSELLQYERRFSELNVCIQEKLQQTRKLYATYNALLEIKDLMLKETSLLNSIGSQFQDVIGTPAGRVKLIDSMEGVMKGIQQKIGKIQLGLQEEQRLRDASKEKYIAAAAEQRKCYTVLRAYQEECTKNERLRSHISAMNEHL

SEQ ID NO: 143 - protein, 804 aa, Arabidopsis thaliana
MAATLLSQCYRIYNSDACKCVSSENHQTTGKRNGNRNLEFDSGISKPARLVLRDRYKVTKQVNDPALTRALRGFADSRLMEDALQLFDEMNKADAFLWNVMIKGFTSCGLYIEAVQFYSRMVFAGVKADTFTYPFVIKSVAGISSLEEGKKIHAMVIKLGFVSDVYVCNSLISLYMKLGCAWDAEKVFEEMPERDIVSWNSMISGYLALGDGFSSLMLFKEMLKCGFKPDRFSTMSALGACSHVYSPKMGKEIHCHAVRSRIETGDVMVMTSILDMYSKYGEVSYAERIFNGMIQRNIVAWNVMIGCYARNGRVTDAFLCFQKMSEQNGLQPDVITSINLLPASAILEGRTIHGYAMRRGFLPHMVLETALIDMYGECGQLKSAEVIFDRMAEKNVISWNSIIAAYVQNGKNYSALELFQELWDSSLVPDSTTIASILPAYAESLSLSEGREIHAYIVKSRYWSNTIILNSLVHMYAMCGDLEDARKCFNHILLKDVVSWNSIIMAYAVHGFGRISVWLFSEMIASRVNPNKSTFASLLAACSISGMVDEGWEYFESMKREYGIDPGIEHYGCMLDLIGRTGNFSAAKRFLEEMPFVPTARIWGSLLNASRNHKDITIAEFAAEQIFKMEHDNTGCYVLLLNMYAEAGRWEDVNRIKLLMESKGISRTSSRSTVEAKGKSHVFTNGDRSHVATNKIYEVLDVVSRMVGEEDIYVHCVSRLRPETLVKSRSNSPRRHSVRLATCFGLISTETGRRVTVRNNTRICRKCHEFLEKASRLTRREIVVGDSKIFHHFSNGRCSCGNYW

SEQ ID NO: 144 - protein, 1049 aa, Arabidopsis thaliana
MFVKKLVEIAAKKPGGSSSEGLRANDVEPRIALHYGIPSGSHLFAYDPFQKILAVSTKDGRIKLFGKDQTQALLVSEETSTSRFLEFVQNQGILLNVNSKNQIEVWDLDKKLLSHVHVFNGEITSFRVMQHTPYFYVGDSSGNVSVFKIEQDSNQVIQLEYTIPYLASNGSPIEASEDTSVVSILPQLTAESKRILLVFSSGFIALWDIKESKPILKTGVHGMVKQDTKKATCACWVCPSGSRVSVGYSNGDILIWSIPSKGECSPESSAMICKLNLGYKSEKIPIASLKWVYAEGKASRVYVIGSSSNSLQVVLLNEQTETRMIKLGLHVSEPCADMEMIIADVNEQSKHKQDFLFVLGKSGRVYAYDDYMIEKYLIQSQSKSSPSLPKETVVKLPFSDSSSITVGKFLTNPSHLLNLSDEDYAQLAKDAVPFLPFHTVPKESSRSAHFPGFTKVKNVYITGHCDGTISVWDMTCSFPILVLFLKEQIDQDVSSRGNAALTALHYDSNSRLLVSGDHNGMVRLYRFKPEPYLTENSFIPFQGSLKKGNNHIVQSVKYIKLTGSITCIQKSQNSKHLAIGSDQGHVSLVDIEEANVLYTKHIASDICPGIISLQFESCIVQGFEKNVLVVAMRDSSVFALDSDTGNMIGTNMIKPKKPFKVLYMQILDGKQDTSGNGFDTSRESTVEEISIRQPSVLVCSEKAIYIYSLAHVVQGVKKVLHKKKFSSSPICSASTFYGTSGVGLTLVFTDGTVEIRSLPELSQLKQTSIRGFTYSSPKPNSLPEITISASWDGDLVMVNGDDELIVSSVLPQKETFRLVESMNRVYKKDNSVCHEGIITSSSPREKKSMFGSVFKTKSKRTTDTEPESSKETIEELSKIFSTANFPWNNNVENSREINTITRVEDEEELDIDDIDIDDHHPNQQQQEKPKEQGILSGLSKQKMANRFSNFKGKLKQMAAKNEKSVVTNDEKHEEKNGATVDQIKKKYGFTSSDEMGAAKMAQSKLQDNLKKLQGISLRTTEMEDTAKSFSSTAKELLNAVEFNKQSSKS

SEQ ID NO: 145 - protein, 1807 aa, Arabidopsis thaliana
MPPGVRQLTVLGKFKPFGLIAEATDGKSPDDSYQYFLFDPELTGERDDADGNDANFSRQREHELFIRDNCIIWTSGSRVLKRFTLSSAVIKACWSNLGRGTEAFLCVLQIACLTIYNTSGEVVSVPLMRTVKSIWPLPCGLLLEQAGEVNPPSHVPFSPVSPILGSREMLRQRKEVGNSSPQNFHSPVAHDLISKRDMPCMSSHLILRDPLEEPGPTYVEERGKLTIMKDYDERTIWTSDRLPLMTSYNKGKMQHSVWAAEFIESNLEASASCSSGIVPDAVLSKRVSFRRIWQAKGAKKAASKVFLATDNSVPVICFLILEQKKLLSVGLQTVEINNEILFDVKPDISWSVSAIAAAPVVVTRSQVKIGLLPHLDIIVLSPENDLFLYSGKQCLCRYVLPSWLGESIGSGDGESAKTDSGFRNLKITGLSDAVLGSINLSVNHSQIFRCALTGKPSSSLANDCIAAIAEGLRSDLYSLFLSLLWGDGHSDLQGSSIHFEWEALCNIFLEICQKPTVVHRKQPKTASESSWEFLLISKFHKTYSRFHNGITSINRLDLEGIVPFDSKICSEETLGSSCELMVQSLDCLHAVYESLKMDNLRKQDLHHLAVLLCNIAKFLDEKCYLDYYIRDFPRLSTTIGACTTLSSSRKPPNLFRWLENCLRRGCLSTNFDDLPDLIRRDGCSIVSWARKVVSFYSVLFGDKPEGRTLSSGVPCNIAPGSYSCNEELTILAMAGERFGLHQLDLLPSGVSLPLRHALDSCRESPPADWPAIAYVLLGREDMALSVFRNFSSSKEFEMQSNTSLISMSIPYMLHLHPVIVPSSESIGLENTKIEDTNSVDGSVIDGMEHIFNSYTQLRYGRDLRLNEVRRLLCSARPVVVQTAANPTISDQEQQQDHLWHIAQRTAVLPLGRGAFTLSTIHTLLTEAFTVPKLVLAGRLPSQQNAIVNLDPNIRNIQELKTWPEFHNAVAAGLRLAPLQGKVSRTWIRYNKPGEPNAVHAGLLFGLGLQGYLHVLNLSDIYQYFTQDHESTTVGLMLGLAASYRGTMQPDIAKALFFHVPARYQASYTEFEIPTLLQSAALVSVGMLFEGSAHQQTMQLLLGEIGRRSAGDNVLEREGYAVSAGFSLGLVALGRGGDALGSMDSLVNRLLLYLGAKEERSILVPSLEDHRSAAQITDGSTSNVDITAPGAIIALTLMYLKTESEVIFSKLSIPQTHYDLECVRPDFIMLRVIARNLIMWSRICPTCDWIQSQVPEVVKNGISQLRDDMDNMYEVDVEALVQAYVNIVAGACISLGLRFAGTRDGNARDLLNSYALYLLNEIKPLSATPGNAFPRGISKFVDRGTLEMCLYLIIISLSVVMAGSGDLQVFRLLRFLRSRNSADGHANYGTQMAVSLATGFLFLGGGMRTFSTNNGSLAMLLITLYPRLPSGPNDNRCHLQAFRHLYVLATEARWLQTIDVDSGLPVYAPLEVTVKETKLYSETKFCEITPCILPERAILKRICVCGPRYWPQQIELVPEEKNWWSFGDKSDPFSSGVIYVKRKVGACSYVDDPVGCQSLLSRAMHKVFGLRTLGESNLIANSHRELDSDSVDHLVSTFSSDPSLIAFAQLCCDKSWNNRSDSEFKEFCLQVLFDCISKDRPALLQVYLSLYTTIGSMADLLVKSDSNMCDSLSISSLKVALAYNEAVSTGRLASSGGFVQSIFLASLRKRCEEVLNCSTELKINLRNYLTSEAWPYDKNSKLQKDIIILSWYLKWFNVPSPSIIKAAVEKIKSKSKNSTSAIPLLRLLLPNTHISVIGEIDRVFFPSN

SEQ ID NO: 146 - protein, 185 aa, Arabidopsis thaliana
MAALASNPQMLTRQAHGNKKEQLWRKESLNLEKKCGFCVSVYSNEKLGRSHMEKEWRLKAFWSNIAQPTTLEMEPINNVEELDAVLSHARQLSQPIIIEWMASWCRKCIYLKPKLEKLAAEYNNRAKFYYVDVNKVPQTLVKRGNISKMPTIQLWKEDEMKEEVIGGHKGWLVIEEVRELINKFV

SEQ ID NO: 147 - protein, 527 aa, Arabidopsis thaliana
MEFDEYEYLEKTVEEGAGSNKKKEESGNERSERSYRKREGGERQGEEGGEEERVSSRSKKSRGDGEENGGGKRDRERERHRSSRDKDRERDKVREGSRDKESDRERSSKERDRSDRDKPRDRERREREKRSSSRSRREEKEPEVVERGSRRHRDKKDEPEADPERDQRTVFAYQMPLKATERDVYEFFSKAGKVRDVRLIMDRNSRRSKGVGYIEFYDVMSVPMAIALSGQLFLGQPVMVKPSEAEKNLAQSNSTTVGGTGPADRKLYVGNLHFNMSELQLRQIFEAFGPVELVQLPLDPETGQCKGFGFIQFVQLEHSKAAQIALNGKLEIAGRTIKVSSVSDHIGTQDSAPKSADFDDDDGGGLALNAQSRAMLMQKLDRSGIATSIVGSLGVPGLNGAAFNQPGMNPSFPTSVLPTTAIPSFVNEHVGLPSECLLLKNMFDPATETEPNFDLEIRDDVADECSKYGPVNHIYVDKNSAGFVYLRFQSVEAAAAAQRAMHMRWFAQKMISATFMPPHEYEAKAKA

SEQ ID NO: 148 - protein, 861 aa, Arabidopsis thaliana
MKSGLIITIALLLYTSSFVLVSVAKECTNTPTQLSSHTFRSELLQSKNETLKTELFSHYHLTPADDSAWSSLLPRKMLKEEADEFAWTMLYRKFKDSNSSGNFLKDVSLHDVRLDPDSFHWRAQQTNLEYLLMLDVDGLAWSFRKEAGLDAPGDYYGGWERPDSELRGHFVGHYLSATAYMWASTHNDTLKEKMSALVSALSECQQKSGTGYLSAFPSSFFDRFEAITPVWAPYYTIHKILAGLVDQYKLAGNSQALKMATGMADYFYGRVRNVIRKYSVERHWQSLNEETGGMNDVLYQLYSITGDSKYLLLAHLFDKPCFLGVLAIQADDISGFHANTHIPIVVGSQQRYEITGDLLHKEISMFFMDIFNASHSYATGGTSVSEFWQDPKRMATALQTENEESCTTYNMLKVSRNLFRWTKEVSYADYYERALTNGVLGIQRGTQPGLMIYMLPLGKGVSKAVTYHGWGTPYDSFWCCYGTGIESFSKLGDSIYFQEDGATPALYVTQYISSSLDWKSAGLSISQKVNPVVSWDPYMRVTFTLSSSKVGVAKESTLNLRIPVWTNSIGAKVSLNGRPLNVPTSGNFLSIKQKWKSGDQVTMELPMSIRTEAIKDDRPEYASLQAILYGPYLLAGHTSRDWSITTQAKPGKWITPIPETQNSYLVTLSQQSGNVSYVFSNSNQTITMRVSPEPGTQDAVAATFRLVTDNSKPRISGPEGLIGRLVMLEPFDFPGMIVKQATDSSLTVQASSPSDKGASSFRLVSGLDGKLGSVSLRLESKKGCFVYSDQTLKQGTKLRLECGSDATDEKFKEAASFSLKTGMHQYNPMSFVMSGTQRNFVLSPLFSLRDETYNVYFSVQT

SEQ ID NO: 149 - protein, 375 aa, Arabidopsis thaliana
MDFDSISRESTFLSPLLNQNAMWQMNLGSDDTMGVDGSYPERHGEPDCAYYIRTGLCRFGSTCRFNHPHDRKLVIATARIKGEYPERIGQPECEFYLKTGTCKFGVTCKFHHPRNKAGIDGSVSVNVLSYPLRPNEDDCSYFLRIGQCKFGGTCKFNHPQTQSTNLMVSVRGSPVYSALQSLTGQPSYSWSRTSFVANPPRLQDPSGFASGSQGGLFSSGFHSGNSVPLGFYALPRENVFPERPGQPECQFYMKTGDCKFGTVCKFHHPRDRQTPPPDCVLSSVGLPLRPGEPLCVFYSRYGICKFGPSCKFDHPMRVFTYNNNTASPSPSSSLHQETAITTELRNLLVSSSVEAKPTSLPETTSAKDTIVDAQH

SEQ ID NO: 150 - protein, 95 aa, Arabidopsis thaliana
MKFMTLMVITFVIIVLSSPILMKAEETQSCVPMELMPCLPAMTKREQPTKDCCENLIKQKTCLCDYIKNPLYSMFTISLVARKVLETCNVPYTSC

SEQ ID NO: 151 - protein, 106 aa, Arabidopsis thaliana
MRILKTQRSRGGRRTSKKFGNRRTSGGEKFSEKLQALKSLLPPPSKMTEQSRQDAYVEEDSSVGETEQLFQETADYIVRLRGQVVVLQKLIEIYGSSDQKEDNFVS

SEQ ID NO: 152 - protein, 581 aa, Arabidopsis thaliana
MSLCSDLTEKLDEEILEDLTSNVKQIQDNVLEEILTLNANTEYLRRFLHGSSSKELFKKNVPVVTYEDVKPFIDRVTNGEPSDIISGNPITGFLLSSGTSGGKQKMFPRNNKYLENIKFIFYYRSLVISKHIDGLEHGKGMVFNFCTSENTTPSGLPSSAASTSFFKSDYFKNRPSYWHWSYTSPDEVILCSDTKQTLYCHLLCGLVQRDDVVKVGAAFVTILVRAINLLENSWKEICTNIRFGHLSEWITDISCRDSVSKILGEPNPELADLIENECNNKSWEGIVPRLWPKAKFIECIATGQMAQHIPTLEFYSNKLPSISSSYVSSETMFGINMSPLCKPENVSYTFLPNLSYFEFLLVDAGDKTEIVDLVDVKLGCYYEPLVTNHSGLHRYKMGDILLVTGFYNNAPQFRFVRRGNLTLSIHLEITTDEDLLNAVTDAKMVLESSNLMLMDFTSYADISTTPGHYVLYWELKAKYRNDIVEIDKNVLVECCYVVEESLNNSYRVYRSKGGLIGALEIRLVQQGTFDALMEFFITQGASSTQYKTPICIKSTEALVILEENVHACFFTDKSLSLNFSS

SEQ ID NO: 153 - protein, 211 aa, Arabidopsis thaliana
MWSVTGALTVAVPPTAAACRTKPFLISSSFPKQTKKLHLSSPSLSLPSSHFSSSFKTAATSIEQQSSVNKGESTKYHFLVANAKFMLDEEEHFQEQLFERLRYFGERELVQDFWLVIEPKFLDNFPKITQRLRRPAVALVSTNGTWITFMKLRLDRVLYDSFEATSLDEALASNPTTLEFDKPKNWVAPYPKYEPGWWDTFLPKVTQESAV

SEQ ID NO: 154 - protein, 252 aa, Arabidopsis thaliana
MDSFDFDNVKAEKAKALRRFNRFCRIGRFFRAAEVCVALLFIFWTFSQLPFVVQISGAFLRRIAAVISTPLFVFLLGNSIVVVLLTKSSDQTTTAVASAETEIYQAFVRSVENRSKPSDEDLTEGIVYDDKQVIVTDLDSNPNLTVDENMPHVEIDSDSSPHSKVYGRSKSDVSGKQSSNMVMMMMKRSLQRSETEKFCKETENDDDSEEEKNYPEDDLSNEEFQKTIEAFIAKQRMFRRQESLAVVVHNIA

SEQ ID NO: 155 - protein, 301 aa, Arabidopsis thaliana
MSDELSHKNLDPVKKYAQPVPLKHGSWRCNYCHKVTNGGVKGAKQHILGGFRNVTQCSLVPPIMREEIKDSMLKKTEIKATTQMMPPPATSYDDYGEEEEAAEVLGNERRQPPVKKQKGLMDMFVCPTLPNVLKVLKDANMLYDHLDLMVDEVGEANVVKVVIDNASNYVKASQLSMANRPHLYWTPCAAHCIYLMLEDIGKISEVKTVITQCIFKNDYIYGHTSLVNMMRKIHKRWKSAKIGCNTVCYVFHTIGQYHKQRKNLRNSATSQEWADSKWQKEIGARTVKRIIMQDSFWHKDG

SEQ ID NO: 156 - protein, 251 aa, Arabidopsis thaliana
MGNCCVSSGTTDRENENVSDKNTTIVEEETVVKEVLSETTLFTPSSSFRTSTFKDPVKTKIREDEEKKPGFLKMASDPVLIRPGSVDPEEGSEVSEICSLSLSESVSSTVVMNGYDEEHVMMKQRKSQRSPAKTRTQVTGNNYPTRRTDQSPRKRNNGTCNGARYGSGVRDPGERSGRRSRSPATNRSVMDSNQSSRVGGAKTRKNNQSPGRVRLDPAKNGLDQQQHQNYGYTTEELLENPLVSLECFIFL

SEQ ID NO: 157 - protein, 297 aa, Arabidopsis thaliana
MSRVLTCPPLVFARNHVGVQNLVESTKLKRITLDSKKAHRIEKKEKKEKRKEKKETKREKSHKHSIKATDNHHKLIFLPSKKVSDESDSLEKSGLTDELEEPQKHLGYLSDGSQNSKKRIRDDSPPAVESLIKAAPVAGKPLRIRMVFKKPKEEVPTLPREAVVCSTTVAKSLSHQDVITSSISSSKTSELEKNLPSTSIAAIDETKKRKKHRSSKEDQYNALFDGWTPPSMCIADASSNDNGDYWLFGNKTQEVLKPKAAVKVDDDTMMRPGDSSWPRAQFLSEVGIYSLPYTVPF

SEQ ID NO: 158 - protein, 77 aa, Arabidopsis thaliana
MSLAIAEVYTVRKFHRESMKKPAKQTVTGEGDEKIGGGSFKEAPVKSGGCRRFGRWFFGKPGMKKSSAKVSDPMAIE

SEQ ID NO: 159 - protein, 78 aa, Arabidopsis thaliana
MGFWTLMEGLLLFANALAILNEDRFLAPKGWTLAELHQTGKRNSLKGQIIGLIHACHYMRLPLMLFNLIVIVFKLFSG

SEQ ID NO: 160 - protein, 243 aa, Arabidopsis thaliana
MEVSTSSMSSKPEQMQNPPPMISSPRFQPQIISPHHHDQHQHLSNPYPTTFVQADTSTFKQVVQMLTGSSTDTTTGKHHEAPSPVNNNNKGSSFSIPPIKKTNSFKLYERRQNNNNMFAKNDLMINTLRLQNSQRLMFTGGNSSHHQSPRFSPRNSSSSENILLSPSMLDFPKLGLNSPVTPLRSNDDPFNKSSPLSLGNSSEEDKAIADKGFYLHPSPVSTPRDSQPLLLPLFPVASPARNS

SEQ ID NO: 161 - protein, 748 aa, Arabidopsis thaliana
MELVSGKVVPGCSNAGNPFHECTAICFERVNSPDVHKKEKKLFGFGKRTPSRDQTPPASPARGSRSPLASYFAKKKVESSAESSPSSYDHTNGNFLSRLSPLQGRKIEPSSNVDSLPVSPSLALYSGGDYFARRADQRGDEDDDVSPRPFGTQPKTPEHPLRTPQHRPRTPQHRSAHQEDAFSLETRPRTPERRSNTSDTRPRTPIHESAATGRRPQTPETRPRTPDHRYATYDNRPRTPIHESAATERRPQTPETRPRTPEHRSAIPDTRPRTPIHESAATGRRPQTPETRPRTAQRRGRSPEFMERSPGPRSKTPEPQPTYFEPSSRTPKQRSKTPEPSPRIPQTQPMSHRSLDNAALKMPRTVETRPRTPEHQPRTVETKPRIHESRPKTAVYGGRSPDHREKISQEMGQRSSHAYNYLGSKAESVYIEKNEESVLLFPELILSPQERPPSRLITLNHRGYETPNKQKEHCDEMDDSASTDDDKFSFVDDHDEHTVSIYAETTSKSGSSEQEEQHKANNEPPELPDESQSFSLAEISRMKGIITNNEIRDVMQSILSESYVSVGQYKVRASVSTTLQHILQKHGDIASGSKLQSLATRSYYLDMLASVVFELQTTPLKYLKESRVVEMVAIVKDIESVKIKAGWLKPVLEEIVEAVKHYDEHKMSVVEKEVWERDVLLAKQETEKQVKELGEKEKKIKEWRAKMTEMAAKLGDLDMKRARLHKSFTFLSSKVDKFQGKPLLQGIL

SEQ ID NO: 162 - protein, 502 aa, Arabidopsis thaliana
MSGFEDGFSAEKLFSQGYSYTYDDVIFLPHFIDFSTDAVSLSTRLSKRVPLSIPCVASPMDTVSESHMAAAMAALGGIGIVHYNCDIDTQASVIRHAKSLQVPIASDAVFKCPEHQIGSVDDFGPSSFVFVSQTGTLTPKLLGYVSKSEWSSMKDDQKEVKIYDYMKSCENKDYYVPWDIDLDKIEAVLEDKQKGFVVLEKEGETVNVVTKDDVERVKGYPKLGSGTVGADKKWMVGAAIGTRESDKERLEHLVKAGANVVVLDSSQGNSIYQLEMIKYVKNTYPELDVVGGNVVTMYQAENLIKAGVDGLRVGMGSGSICTTQEVCAVGRGQATAVYKVSTLAAQHGVPVIADGGISNSGHIVKALVLGASTVMMGSFLAGSTEAPGAYEYRNGRRVKKYRGMGSLEAMTKGSDQRYLGDTAKLKIAQGVVGAVADKGSVLKFIPYTMHAVKQGFQDLGASSLQSAHELLRDNTLRLEARTGAAQIEGGIHGLVSYEKKSF

SEQ ID NO: 163 - protein, 692 aa, Arabidopsis thaliana
MGTRWRRMKLALGLNLCTYLPRTLEESPTPLNSTERLSDVALLSPLNWPMTPTPSSHGLKLSRNSSKSSKTCSICLNKMKEGGGHALFTAECSHSFHFHCIASNVKHGNQVCPVCRAKWKEIPMQHPSFDLPYLFARSYNNDAAISLVHRLPRSRGVMNQGRGLAPEPSMFDDDERLEQQLVFSGKSYSDALENNHPVRMMDLKIYPEVSAVPRADSREKFDVLVHLRAAAMVTGNANSLNNQISRYPRAPVDLVTVLDISGSMAGTKLALLKRAMGFVIQNLGSNDRLSVIAFSSTARRLFPLTKMSDAGRQRALQAVNSVVANGGTNIAEGLRKGVKVMEDRRDKNPVASIILLSDGRDTYTMNQADPNYKLLLPLSMHGCESKRFQIPVHSFGFGSDHDASLMHSVSETSGGTFSFIESESVIQDALAQCIGGLLSVAVQELRLEIEGMCSDVHLSSIKAGSYQSLVSGDGRSGCVDIGDLYADEERDFLISVNIPPQKDGNETPLLKMRCVYKDLLTKEIVTLQSHMLKIQRPETVGQEVVVSIEVDRQRNRFLAAEAMVKARALAEREDLAAGVTAIQNFRVALAETVSAKSGDGFCVALDRELKEMQERMASRHVYEVSGRAYILSGLSSHSWQRATSRGESGDGSSFVQAYYQTPSMVEMLHRSQATSHHHRLIQPLFASQPKPR

SEQ ID NO: 164 - protein, 347 aa, Arabidopsis thaliana
MGSFVKEETSSLMTDFLEKCGGYAVVDGGFATELQRHGADINDPLWSAKCLITSPHLVTKVHLDYLESGANIIITASYQATIQGFVAKGLSVGEAENLLRRSVEITYEAREIFYNRCTKGSWDFAYAGKASRRPILVAASVGSYGAYLADGSEYSGIYGDSVSKETLKDFHRRRVQILAKSGADLIAFETIPNKLEAEAYADLLEEEDIDIPAWFSFTSKDGVSVPRGDSVVECAKVADSCKNVVAIGINCTAPRYIHALIISLRQMTRKPIVVYPNSGEVYDGLNKKWIKSEGESEEDFVSYVSKWRDAGASLFGGCCRTTPNTIRAIAKVLSDEPSAASKPKFGQ

SEQ ID NO: 165 - protein, 241 aa, Arabidopsis thaliana
MADNLRRAVQDINLGVDDIPFALPEDIVNHAVAENRFILFGRPVMPRRQNLRSIVASMPRIWGQSGLVHGRIMEGRQFHFIFTLEESLETVLRRGPWAFNDWMILLQRWEPQIPLFPFIPFWVQIRGIPFQFLNRGVVEHIGRALGQVLDTDFNVEVVARMDFARVLLHWDITHPLRFQRHFQFTAGVNTLLRFRYERLRGFCEVCGMLTHDFGACLIQNGGEEQADDDDDDEEHPQTYHN

SEQ ID NO: 166 - protein, 285 aa, Arabidopsis thaliana
MSLRSESSTAEKITEDPVTYKTAQSSVTCIYQAHMVGFWRNVRVLWSKNLMNHSLTVMVTSVQGDMNYCCKVDLKPWHFWYKKGYKSFEVEGNQVDVYWDFRSAKFNGGPEPSSDFYVALVSEEEVVLLLGDHKKKAFKRTKSRPSLVDAALFYKKENVFGKKIFSTRAKFHDRKREHEIVVESSTGAKEPEMWISVDGIVLVQVRNLQWKFRGNQTVLVDKEPVQVFWDVYDWLFSTPGTGHGLFIFKPESGESETSNETKNCSASSSSSSSEFCLFLYAWKLE

SEQ ID NO: 167 - protein, 390 aa, Arabidopsis thaliana
MTKNSNHDENEFISFEPNQNTKIRFEDADEDEVAEGSGVAGEETPQDESMFDAGESADTAEVTDDTTSADYYFDSYSHFGIHEEMLKDVVRTKTYQNVIYQNKFLIKDKIVLDVGAGTGILSLFCAKAGAAHVYAVECSQMADMAKEIVKANGFSDVITVLKGKIEEIELPTPKVDVIISEWMGYFLLFENMLDSVLYARDKWLVEGGVVLPDKASLHLTAIEDSEYKEDKIEFWNSVYGFDMSCIKKKAMMEPLVDTVDQNQIVTDSRLLKTMDISKMSSGDASFTAPFKLVAQRNDYIHALVAYFDVSFTMCHKLLGFSTGPKSRATHWKQTVLYLEDVLTICEGETITGTMSVSPNKKNPRDIDIKLSYSLNGQHCKISRTQHYKMR

SEQ ID NO: 168 - protein, 499 aa, Arabidopsis thaliana
MEALMLIFTFCFIVLSLIFLIGRIKRKLNLPPSPAWALPVIGHLRLLKPPLHRVFLSVSQSLGDAPIISLRLGNRLLFVVSSHSIAEECFTKNDVILANRQTTISTKHISYGNSTVVSASYSEHWRNLRRIGALEIFSAHRLNSFSSIRRDEIRRLIGRLLRNSSYGFTKVEMKSMFSDLTFNNIIRMLAGKCYYGDGKEDDPEAKRVRTLIAEAMSSSGPGNAADYIPILTWITYSETRIKKLAGRLDEFLQGLVDEKREGKEKKENTMVDHLLCLQETQPEYYMDRIIKGTMLSLIAGGTDTTAVTLEWALSSLLNNPEVLNKARDEIDRMIGVDRLLEESDIPNLPYLQNIVSETLRLYPAAPMLLPHVASKDCKVGGYDMPRGTMLLTNAWAIHRDPLLWDDPTSFKPERFEKEGEAKKLMPFGLGRRACPGSGLAQRLVTLSLGSLIQCFEWERIGEEEVDMTEGPGLTMPKARPLEAMCRARDFVGKILPDSS

SEQ ID NO: 169 - protein, 501 aa, Arabidopsis thaliana
MFYYVIVLPLALFLLAYKLFFTSKTKRFNLPPSPPYSLPILGHHNLLKPPVHRLFHRLSKTHGPIFSLQFGSRRAVVISSSSLATQCFTGQNDIILSNRPCFLTAKYVAYNYTTVGTAPYGDHWRNLRRICSLEILSSNRLTNFLHIRKDEIHRMLTRLSRDVNKEIELEPLLSDLTFNNIVRMVTGKRYYGDEVHNEEEANVFKKLVADINDCSGARHPGDYLPFMKMFGGSFEKKVKALAEAMDEILQRLLEECKRDKDGNTMVNHLLSLQQNEPEYYTDVTIKGLMLGMMIAGTDTSAVTLEWAMSSLLNHPEALEKAKLEIDEKIGQERLIDEPDIANLPYLQNIVSETFRLYPAAPLLVPRSPTEDIKVGGYDVPRGTMVMVNAWAIHRDPELWNEPEKFKPERFNGGEGGGRGEDVHKLMPFGNGRRSCPGAGLGQKIVTLALGSLIQCFDWQKVNGEAIDMTETPGMAMRKKIPLSALCQSRPIMSKLQAHLKG

SEQ ID NO: 170 - protein, 241 aa, Arabidopsis thaliana
MLHLLLLSDEEHSTTNSMPPSSSASRSASNHSSSSSSSSSSLHLCKHSPSATLDLLILILVLFSGAFLLSSYFSYLFHSFSLLSSHFPSLSSLIFSDDEDLSSIPPASYFFAFAVFFAASIAFLDLCCGPRSRKCRNPKCKGLKKAMEFDLQLQTEECVKSGATKEIDRLPWKGGSESNPDYECLRAELRRMAPPNGRAVLLFRSRCGCPVAKLEGWGPKRGRRHKKSQANLALKGGVDHR

SEQ ID NO: 171 - protein, 147 aa, Arabidopsis thaliana
MLLGKRQRPPIKRTTSLSEIKFDLNQPSEQEPSDHQIQLVNVDEHRQVHQRLLDQRLLAMVSPRGTQRRHSSDYSEDFLRSCSLCKRLLVHGRDIYMYRGDRAFCSLECRQQQITVDERKEKKKGSVRSTIVVATGTTTGERVSAAV

SEQ ID NO: 172 - protein, 589 aa, Arabidopsis thaliana
MGGPAYDCLTNPLGAVRFSFVNALSSGYDPASSVGKDWGVVDLFRHYFSDESAISQVPILDSSSIKWVQPKTLVRFRGMIQDMLGNEFYAGAYKDDSTWRTNKYSDVSQFPEGSSTEIQVWERRLLYCVPVPGKNQWTECSSQELKNRFLDLTGQNREKRVRVDEEMTDSMDSSTLEAGRNGSPFKKMKVGEATSSASESQVPQTSGIPPATSADSLPCLVKIYDSPESDLKLNDVVEFLGVLTFDPIVMMDTDTLDENSDALSEAESVQMPSGKVPRLHCLIHRKLETQHFLHGSSLLPEPKSPQIFKEIRESLMKYLTGLLGNDHIAAQFLLLHLLSKVHGRVDNVAVGKLSLNLIHLNKESMSIFGTQLSGALKSLLPFTQSIPLTIEYLNTASFGPKKDYGINRLMPGVLQIADGTHLILDETELQPGTLNSVGVENANLLKNLLECQKVEYDFQYYKMEMATDVQMLIFSEGKSNIMPADLVLPLQPSQVNSLEVITPETAETWRCYLATCKSLSHSIGQELQQVVENDLVAARQTDRSLGSQDLSRLLTMARMMSVSYGETTLSLEHWQMVLELERLRKERLK

SEQ ID NO: 173 - protein, 368 aa, Arabidopsis thaliana
MGVLSMKGGDGEHSYANNSEGQKRLASDAKPVVVETVKEMIVKTDFPGCIKVADLGCSSGENTLLVMSEIVNTIITSYQQKGKNLPEINCCLNDLPDNDFNTTFKLVPAFHKLLKMDVKGKCFISGVPGSFYSRLFPSKSLHFVHSSLCLHWLSKVPDGLEDNKKNVYLRSPCPPNVYKSYLTQFKNDFSLFLRLRADETVPNGRMALTFVGRKSLDPLSKDCFQNWSSISDSLLDLVSEGIVKESDVDSFNLPFYNPDESEVREVIESEGSFKISNFETIFGLLFSYKTGRTEVKDDDDNLDQSCRFEVIRKRASIIRSITEPMLGAHFGDAIMDRLFERYTYHLAERYDTLRNKPTVQFFVSLTRK

SEQ ID NO: 174 - protein, 1249 aa, Gossypium hirsutum
MTPPAGSFSGDRENDGDATKKKKKQRKVPLLKLFSFADFYDHVLMGLGSLGACVHGASVPVFFIFFGKLINIIGMAYLFPKEASHKVAKYSLDFVYLSVAILFSSWIEVACWMHTGERQAAKMRMAYLKSMLNQDISLFDTEASTGEVISAITSDIIVVQDALSEKVGNFMHYISRFIAGFSIGFARVWQISLVTLSIVPLIALAGGIYAYVATGLIARVRNSYVKAGEIAEEVIGNVRTVQAFAGEERAVKSYKDALMNTYTYGKKAGLTKGLGLGSLHCVLFVSWALLVWFTSIVVHKNIANGGDSFTTMLNVVISGLSLGQAAPDISAFIRARAAAYPIFEMIERNTVSKTSSKTGRKLSKVEGNIELKNVSFSYPSRPDVVIFDRFCLNIPTGKIVALVGGSGSGKSTVISLIERFYEPLAGEILLDGNNIKGLDLKWLRQQIGLVNQEPALFATTIRENILYGKDDATVDEITRAAKLSEAIAFINNLPDRFETQVGERGIQLSGGQKQRIAISRAIVKNPPILLLDEATSALDAESEKSVQEALDRVMVGRTTVVVAHRLSTIRNADVIAVVQNGKIVETGTHDELISNPNSTYSSLVQHQETSPLQRYPSQGPTLSRPLSVSYSRELSRTRTSFGASFRSERDSVSRAGADGIDAGKQPYVSPGRLYSMIGPDWYYGFFGTVTALIAGAQMPLFALGVSQALVAYYMDWETTCHEVKKIAILFCCASVITVIVHAIEHLCFGIMGERLTLRVREGMFSAILKNEIGWFDDLNNASSMLASRLETDATFLRGVVVDRTSILIQNVGLVIAAFIIAFILNWRITLIILATFPLIISGHISEKLFMQGYGGNLSKAYLKANMIAGEAVSNMRTVAAFCAEEKILDLYARELIEPSERSFKRGQIAGIFYGISQFFIFSSYGLALWYGSVLMGKELASFKSVMKSFMVLIVTALAMGETLALVPDLLKGNQMVASVFEIMDRKTQVVGDAGEELTNVEGTIELKGVHFSYPSRPDVVIFKDFDLKVRSGKSMALVGQSGSGKSSVLALILRFYDPTSGKVMIDGRDVKKLKLKSLRKHIGLVQQEPALFATSIYENILYGKEGASESEVVEAAKLANAHSFISSLPEGYSTKVGERGVQLSGGQKQRVAIARAVLKNPEILLLDEATSALDVESERVVQQALDRLMRNRTTVMVAHRLSTIKNADRISVIQGGRIIEQGTHSSLIENRNGPYFKLINLQQQQQMEQ

SEQ ID NO: 175 - protein, 72 aa, Arabidopsis thaliana
MSQYDHNQSAGANPPPPMSTCTSPPPPIGYPTNQPSHGSVAQGKVETKSKGDGFFKGCLAAMCCCCALDICF

SEQ ID NO: 176 - protein, 323 aa, Oryza sativa
MASNGGEEKSRVAAGYGGGGYGYGGYEGRDDRKWWPWLVPTVIVACIAVFIVEMYVNNCPKHGSALGGCVAGFLRRFSFQPLRENPLLGPSSATLQKMGALDWNKVVHQHQGWRLISCIWLHAGLIHLVVNMLSLLFIGIRLEQQFGFVRIGAIYLLSGFGGSVLSALFLRNNYISVGASGALFGLLGSMLSELIMNWTIYSNKAAAIITLLFIIAINLAIGILPHADNFAHIGGFVTGFLLGFVLLARPQFGWMERHELPQTNQPPKYKAYQYVLWVVAFVLLLVGFVVSLVMLFKGKNGNDGCHWCHYLNCVPTSKWKCNT

SEQ ID NO: 177 - protein, 453 aa, Oryza sativa
MSSLTAAQFRSLFEMAGGEDISFLFGDDEAAAVAAPVELQGKRGWEEVDQGEGSGAVAAKRQRSPTSSRENSSGSNEGGQEEVSEAAAAMAAAVGRGGGRRLWVKERDSEWWDMVSSPDYPDSEFRKAFRMSKATFEVVCDELAAAVAKEDTMLRAAIPVRKRVAVCVWRLATGEPLRLVSKRFGLGISTCHKLVLEVCAALKAMVMPKVVRWPEAGDAAAIAAHFEAISGISGVVGAIYTTHIPIIAPKSNVASYYNRRHTERNQKTSYSMTVQCVVDSTGAFTDVCIGWPGSNSDEEVLEKSALYLHRGVPGLIQGQWVVGGGSFPLMDWMLVPYTHQNLTWAQHMLNEKVAAVRGVARDAFERLKRRWGCLQKRTEVKLLDLPTVLGACCVLHNICERSGDAVVDADDCAFDLFDDDMVAENAVRSTAAAQARDAIAHNLLHSGGGASFF

SEQ ID NO: 178 - protein, 145 aa, Zea mays
MAASTARTVKDVNPHEFVKAYSAHLKRSGKMELPEWVDIVKTARFKELPPYDPDWYYIRAASVARKIYLRQGIGVGGFQKIYGGRQRNGSRPPHFCKSSGAISRNILQQLQEMGIIDVDPKGGRRITSQGRRDLDQVAGRVAVEA

SEQ ID NO: 179 - protein, 540 aa, Arabidopsis thaliana
MEISSFPFPYLQDDECSHFLGLFQDMDSSPSTFGLEGFNSNDNNTNQKKRPRKDDEGGGGGGGGTEVLGAVNGNNKAAFGDILATLLLLDEEAKQQQEQWDFEFIKEKSLLEANHKKKVKTMDGYYNQMQDHYSAAGETDGSRSKRARKTAVAAVVSAVASGADTTGLAAPVPTADIASGSGSGPSHRRLWVKERTTDWWDRVSRPDFPEDEFRREFRMSKSTFNLICEELDTTVTKKNTMLRDAIPAPKRVGVCVWRLATGAPLRHVSERFGLGISTCHKLVIEVCRAIYDVLMPKYLLWPSDSEINSTKAKFESVHKIPNVVGSIYTTHIPIIAPKVHVAAYFNKRHTERNQKTSYSITVQGVVNADGIFTDVCIGNPGSLTDDQILEKSSLSRQRAARGMLRDSWIVGNSGFPLTDYLLVPYTRQNLTWTQHAFNESIGEIQGIATAAFERLKGRWACLQKRTEVKLQDLPYVLGACCVLHNICEMRKEEMLPELKFEVFDDVAVPENNIRSASAVNTRDHISHNLLHRGLAGTRTL

SEQ ID NO: 180 - protein, 204 aa, Arabidopsis thaliana
MTENQLYSFITMKSSLSKCKQSSSLSFPLFGLINFFLIGFFRWVSFAQLFFSRFWPLVQHQQCVSEKKSKDLEFQTSIKHEEYRDDDDDGLCREDVGMVMKSLGLSTDQENEGLQKQYSSKEVSNLFEEKEPSLEEVKQAFDVFDENRDGFIDPIDLQRVLTILGLKQGSNLENCRRMIRSFDGSKDGRIDFYGFVKFMENNFC

SEQ ID NO: 181 - protein, 504 aa, Arabidopsis thaliana
MNPYDAKDRRWILSMFFFVVLFCNNVSTSSSSSEVITIKPRHLSLLKSALQRSSGEQSDLWRPLTDQGWSPCIDLGNSPSLPDKTAGYVQVFLDGGLNQQRMGICDAVAVAKILNATLVIPYLEVNPVWQDSSSFVDIFDVDHFIDSLKDDIRVVRELPDEYSWSTREYYGTAVRETRVKTAPVHASANWYIENVSPVLQSYGIAAISPFSHRLSFDHLPAEIQRLRCKVNFQALRFVPHITSLGDALVSRLRNPSWRSNKEQKNVDHLGDMTNPHRRQEPGKFAVLHLRFDKDMAAHSACDFGGGKAEKLSLAKYRQMIWQGRVLNSQFTDEELRSQGRCPLTPEEMGLLLAAFGFDNNTRLYLASHKVYGGEARISTLRQVFPRMEDKRSLASSEERARIKGKASLLAALDYYVSMHSDIFISASPGNMHNALVGHRTFENLKTIRPNMALIGQLFLNKSITWVDFQQALGEGHVNRQGQIRLRKPKQSIYTYPAPDCMCHV

SEQ ID NO: 182 - protein, 1535 aa, Arabidopsis thaliana
MMKKKKQSRSQSSSTKKTFEPSSDSSPSPRLLSIIRSKLASSKDLKHMFRGMRSRTVPGLSSQSRIVRCPKCHKLLQEPLDATSYKCGGCDSILHAKRWEPDGNDHTNTIPEALLSSQNRSLSAEVESPEDGSRTPMRTTHREYNSRPSTSVERGYHPETVYKPETSDIRREWMRRTDDFSETGDSDVFTSERSSPYNTRSNAAQWAQHEGRYADPPRVPFYPASPSPSSAYEYGYSSPFHGSYVSASEQSYYHQQPNQFEQYSREGWFQESSVASPTRFPGETSDGKYYHRSSQSQLHDLQYHNLYEPSRSETPHHSVYSERSYVPAAAPHRSTYSEHSVGISKSDTSSEKSILRNKKRYVRERNPVVKRHILPSAGGAPFATCSYCLELLQLPQVSPQGKRQRYQVRCGSCSGVLKFSIREKADTVLDSPSFVDYGMDFADETVTNHQDSASEGHEEINPDGSHLTCLDDDSGETICKSNDAVILSQKILETFEDKGIKEDIRNISTKFLDLKLEALQPHLKPMGNRRLSEQQPTSSETIGETSKIHLEQSQEAHSEKSTEMDNNICDIEEPEYEKNEIIKPEEIVGEGSGESLEVPVNQNERMSESSEEDERVAERSVSHSEELLYKKEYVSETRVQSENTGDTYEFEWEETQETEEYEGESTLEEIGDKPQLHLDKSRYTRDSICDSSLSYGEPFEDTSVKEDTEHISNTISDAKSATTHSPLNSLVNENQRFIGHLDQSGEATVTISRIQEHSKYEYENLSERQELEMTISDRVTCKLEESRYETNETLEPSKVGEDGSLVSFEKVSEAFETIIEGKTGEERLVSHQMDSPNENVENSYGTLEPVYLEESGFAGERTWEGTIEDRAGLHLEEYESNYENYSRPFEWTSETAPTFRMHDYELGTILEPDEYADGRSESSSRGSFNDDGGSEERVVFHESQVAIPEQSHYEYENSSKRQELSDTVFDIARSELQEYRYERNETLEPSKMVGDGSVVPVEKAGETFISKKNEDSSVSHQMESQNEDMENSYGTKEPVYPEGSRCESENSWAETMGDGAGLKLEEYNSNPFEWTSEKAAAFHLHEYERWTVPEPEEDANERSITSSRDSFNDHENLKGIAVSHEEEPWLVDENRTEALKVGVMVEDEPSLHLTKFENETMKLEETLEWTSERAPTFRLPEYELGEMLESDNDVDERSEYSSKGSFNDHEIPRELLNEEDPQLVIDGRTEAVQVGEMAKDTVSLHLEECGNESMKLDETFEWTSGRTLTFRRHGYEVETKLEADEDADGRSESSSRGSFNDRGSSKERAVLHEDGSWLVDDYETKALKVGVMAEDGSSLQLEKGENGKMDLDETLEPRDDIFRLSLDDTLEQERMTFHLKMSQDKQESLRQTFKQGDAEKDSDVFSEGHEFPSKMAELDSDTEEEIVEEQLEHLQKENEKLSLTFEQHDHIYSTTEPSEIVGLRHALYQTQNSPLRSPLTSPIHTPIGSPLHYLMASQIRSPIASTMHSHIVSPLRSPINSSGSLSDVLFFSKKT

SEQ ID NO: 183 - protein, 114 aa, Ricinus communis
MATITVKLISFLVLCLVVAMPMTTEAITCGQVVSGLSSCLSYLRSGGAVPPACCNGVRGLNSAAKTTADRQQVCECLKSAAAGINLSNASSLPGKCNVNIPYKISPSTDCKSIK

SEQ ID NO: 184 - protein, 170 aa, Arabidopsis thaliana
MTIMIKFLLLALLVISPICAEKDLMKEECHNAQVPTICMQCLESDPTSVHADRVGIAEIIIHCLDSRLDIITNNITNILSLGGGTKEVRKILEDCRNDTSTVAPKLLSEAKTGLKTGDYDKAAKSIEYASIPHSCGLKQPSVEFEFLQLFSQISIYTQLSDAAMRIIDRF

SEQ ID NO: 185 - protein, 174 aa, Arabidopsis thaliana
MENMLGLLRLHVIRGVNLAIRDSQSSDPYVIVRMGKQKLRTRVMKKNLNPEWNEDLTLSVTDPTLPVKIMVYDRDRFSRDDKMGDAIFHIDPFLEAIRIQNQLGGLPEGTVIMKIQASRQNCLSEESKIVWHKGKIVQNMFLKLQNVERGEIELQLEWIDVSGALTDDAEDVAF

SEQ ID NO: 186 - protein, 194 aa, Arabidopsis thaliana
MISLTELHAEEGLLRNGELTVVAKVEVLEVVGKLDVSEESSPVIETIDVNGFQVLPSQVEYAKSLFERHLDIASKFRPKNPYLKTAYMNVLLSLTQTICQSPQELSNDDLSDAGAALAYLREAGFELDWLEKKLNEVKEKKKKEEACLAEIQDMDEHVKPLKKKYLDLEAQIDKKKAELLAARAPLSLNDDNVV

SEQ ID NO: 187 - protein, 511 aa, Arabidopsis thaliana
MEILTSIAITVATTIFIVLCFTIYLMIRIFTGKSRNDKRYAPVHATVFDLLFHSDELYDYETEIAREKPTYRFLSPGQSEILTADPRNVEHILKTRFDNYSKGHSSRENMADLLGHGIFAVDGEKWRQQRKLSSFEFSTRVLRDFSCSVFRRNASKLVGFVSEFALSGKAFDAQDLLMRCTLDSIFKVGFGVELKCLDGFSKEGQEFMEAFDEGNVATSSRFIDPLWKLKWFFNIGSQSKLKKSIATIDKFVYSLITTKRKELAKEQNTVVREDILSRFLVESEKDPENMNDKYLRDIILNFMIAGKDTTAALLSWFLYMLCKNPLVQEKIVQEIRDVTFSHEKTTDVNGFVESINEEALDEMHYLHAALSETLRLYPPVPVDMRCAENDDVLPDGHRVSKGDNIYYIAYAMGRMTYIWGQDAEEFKPERWLKDGLFQPESPFKFISFHAGPRICLGKDFAYRQMKIVSMALLHFFRFKMADENSKVYYKRMLTLHVDGGLHLCAIPRTST

SEQ ID NO: 188 - protein, 80 aa, Arabidopsis thaliana
MAITKTSVTLLLLIIMAASLSNFSVLASEIKPTGRVDNQCKEMCSATFGDGKCAADCRKAGFSSGRCLTSSPFGNKCCCT

SEQ ID NO: 189 - protein, 689 aa, Arabidopsis thaliana
MEVSQDGSERDKTPPPSSSSSSSSPIPVVTNFWKEFDLEKEKSLLDEQGLRIAENQENSQKNRRKLAESTRDFKKASPENKLSMFNSLLKGYQEEVDNITKRAKFGENAFLNIYQKLYEAPDPFPALASIAEQDRKLSEVESENRKMKVELEEFRTEATHLKNQQATIRRLEERNRQLEQQMEEKIKEVVEIKQRNLAEENQKTMELLKDREQALQDQLRQAKDSVSTMQKLHELAQNQLFELRAQSDEETAGKQSEVSLLMDEVERAQTRLLTLEREKGHLRSQLQTANEDTDNKKSDNIDSNSMLENSLTAKEKIISELNMEIHNVETALANERESHVAEIKKLNSLLNKKDTIIEEMKKELQERPSAKLVDDLRKKVKILQAVGYNSIEAEDWDAATTGEEMSKMESLLLDKNRKMEHEVTQLKVQLSEKASLLEKAEAKGEELTAKVNEQQRLIQKLEDDILKGYGSKERKGALFDEWEFSEAGVAEQSEPMDQKHVPSEQDQSSMLKVICSQRDRFRARLRETEEEIRRLKEKIGFLTDELEKTKADNVKLYGKIRYVQDYNHDKVVSRGSKKYVEDLESGFSSDVESKYKKIYEDDINPFAAFSKKEREQRIKDLGIRDRITLSSGRFLLGNKYARTFAFFYTIGLHVLVFTCLYRMSAYSYLSHGAEETLMTEATTNLPHGL

SEQ ID NO: 190 - protein, 435 aa, Arabidopsis thaliana
MQSGGDFSNGFHGDHHRELELEDKQGPSLSSFGRAKKRSHAGARDPRGGLANVLRVSDQLGEHKSLETSESSPPPCTDFDVAYFHSYAHVGIHEEMIKDRARTETYREAIMQHQSLIEGKVVVDVGCGTGILSIFCAQAGAKRVYAVDASDIAVQAKEVVKANGLSDKVIVLHGRVEDVEIDEEVDVIISEWMGYMLLYESMLGSVITARDRWLKPGGLILPSHATLYMAPISHPDRYSHSIDFWRNVYGIDMSAMMQLAKQCAFEEPSVESISGENVLTWPEVVKHIDCKTIKIQELDSVTARYKFNSMMRAPMHGFAFWFDVEFSGPASSPAKNTSETSIASGSSSISPSGEVNQKKRTNPSDALVLSTSPESPPTHWQQTIVYFYDPIDVEQDQVIEGSVTLSQSKENKRFMNIHLEYSSAGRSFVKESVMR

SEQ ID NO: 191 - protein, 497 aa, Arabidopsis thaliana
METKTLIFSILFVVLSLIYLIGKLKRKPNLPPSPAWSLPVIGHLRLLKPPIHRTFLSLSQSLNNAPIFSLRLGNRLVFVNSSHSIAEECFTKNDVVLANRPNFILAKHVAYDYTTMIAASYGDHWRNLRRIGSVEIFSNHRLNSFLSIRKDEIRRLVFRLSRNFSQEFVKVDMKSMLSDLTFNNILRMVAGKRYYGDGVEDDPEAKRVRQLIADVVACAGAGNAVDYLPVLRLVSDYETRVKKLAGRLDEFLQGLVDEKREAKEKGNTMIDHLLTLQESQPDYFTDRIIKGNMLALILAGTDTSAVTLEWALSNVLNHPDVLNKARDEIDRKIGLDRLMDESDISNLPYLQNIVSETLRLYPAAPMLLPHVASEDCKVAGYDMPRGTILLTNVWAIHRDPQLWDDPMSFKPERFEKEGEAQKLMPFGLGRRACPGSGLAHRLINLTLGSLIQCLEWEKIGEEVDMSEGKGVTMPKAKPLEAMCRARPSVVKIFNESV

SEQ ID NO: 192 - protein, 533 aa, Arabidopsis thaliana
SCFGSDELLVSRRLFSLRDVQILELFIAFFVFATIHSLRQKKHQGMPVWPLVGMLPSLISAVRSNIYEWLSDVLISQNGTFRFRGPWFSTLNCVVTCDPRNVEHLLKTRFSIYPKGSYFRETMQDLLGDGIFNTDDGTWQRQRKAASVEFHSAKFRQLTSQSLHELVHNRLLPVLETSGKIDLQDILLRLTFDNVCMIAFGVDPGCLSPKLPEIPFAKAFEDATEATVVRFVMPKFVWKLMRSLNLGTEKKLKESINGVDDFAEEVIRTRKKEMSLETEIAKRPDLLTIFMGLRDENGQKFSDKFLRDICVNFILAGRDTSSVALSWFFWLIEKNPEVEEKIMMGICKILEQRVDHGDTKKNMEYEPVFRPEEIKKMDYLQAALSETLRLYPSVPVDHKEVLEDDVFPDGTKLKKGEKVIYAIYAMGRMETIWGKDCREFKPERWLRDGRYMSESAYKFTAFNGGPRLCLGKDFAYYQMRYVAAAIIYRYKVRVDDKGGHKVEPKMALTMYMKHGLKVNMVKRSVSEIDHYYC

SEQ ID NO: 193 - protein, 267 aa, Arabidopsis thaliana
MEASPNDRLHFGKMGFGCKHYKRRCQIRAPCCNEVFDCRHCHNESTSTLRNIYDRHDLVRQDVKQVICSVCDTEQPAAQVCSNCGVNMGEYFCSICIFYDDDTEKQQFHCDDCGICRVGGRENFFHCKKCGSCYAVGLRNNHRCVENSMRHHCPICYEYLFDSLKDTNVMKCGHTMHVECYNEMIKRDKFCCPICSRSVIDMSKTWQRLDEEIEATAMPSDYRDKKVWILCNDCNDTTEVHFHIIGQKCGHCRSYNTRAIAPPVLPQ

SEQ ID NO: 194 - protein, 344 aa, Arabidopsis thaliana
MNLSSRRASSTLTLSFTVLLLASTGSYGSTFTFANRCGYTVWPGILSNAGSPTLSTTGFELPKGTSRSLQAPTGWSGRFWARTGCKFDSSGSGTCKTGDCGSNSVECAGLGAAPPVTLAEFTLGTGGDDFYDVSLVDGYNIPMIVEVAGGSGQCASTGCTTDLNIQCPAELRFGDGDACKSACLAFRSPEYCCSGAYATPSSCRPSVYSEMFKAACPRSYSYAYDDATSTFTCAGGDYTVTFCPSSPSQKSTSYSPPVTDSSSTSQGSDPVPGSDTGYAGQGQQTPGQGNVYGSQGTGSEMGTGETMLQDGSWMAGLAMGEASRPAGVSLTVLLAAFTFPFIFS

SEQ ID NO: 195 - protein, 1606 aa, Arabidopsis thaliana
MAQKPEEQLKELGSKLDLAPVSKDSLLKLLKEAAVCLSELEQSPPPAVLKSIQPFLDAVIKPEILNHQDKDVKLLVASCVSEITRITAPEAPYSDNIMKDIFQLIVSAFAGLNDVSGPSFGRRVLILETVAKYRSCVVMLDLECDDLVKEVFTTFLDVARDDHPEIVFSSMQNIMIVLLEESEDVQEHLLLILLSKLGRNRSDVRDAARRLAMKVIEHCAPKVESDIKQFLISSMSGDSRFSSSQIDYHEVIYDLYRCAPQALSGVAPYLTGELLADKLETRLKVVGLVGELFSLPGRVISEEFDSIFLEFLKRLTDRVVEVRMAILDHIKDCLLSDPLRAEASQIISALCDRLLDYDENIRKQVVAVICDVSVSALTSIPVDTMKLVAERLRDKAILVKTYTMERLTELFRVYCLRCADGKVDTGDFNWIPGKILRCLYDKDFRSDTIEYILCSSLFPSDFSVRDKVKHWIQIFSGFDKVETKAFEKILEQRQRIQQEMQRYLSIKQTQQTADAPEIQKKILFGFRVMSRAFSDPPKTEQNFLILDQLKDANIWKILTNLLDPNTSITQASRIRDDMLKILSEKHSLYDFLSTLSIKCSYLLFSKEYVKEILAEVSVRKSSKNTLGIQPCMDFLGLLACFCPSLFDGAEEELISFLKDDDEMMKEGTLKILAKAGGTIRENLIVLASSVDLLLERICVEGNRKQAKYAVHALASITKDDGLKSLSVLYKRLVDMLEDKRYQPAVLQCLGCIAQIAMPVYETRESEVVEFIRSKILKLKSETVDDKKLSWDDKSEICQLKIYGIKTLVKSYLPFKDAQLRAGVDDLLGILKNILSFGEVSEDLESSSVDKAHLRLAAAKAVLRLSRHWDDKIPIEIFHLTLKTPEIPFPTAKKIFLGKVHQYVKDRVLEMKYACSFLFDITGSNVLESEEDKHNLADIIQHSYQTKVRKISAQTDANSVTLYPHHILPYLVHALAHHSCPDVEKCKDVKEYEMIYRQLYLIISMLLHKEEDGKTEDIDKEREYVPTIILIFHSIKQSEDVTDATKSKNSHAICELGLSIINHLTQKEPDLQGEITPVSLPPTLYKPSEKVEGDKSQVGEEKLWLADETVLLHFRALKLESHADASVIPQTSENEVMIDGESDGNEIPLGKIVERLRAQGTKTRKGKKNKSVPAEDENGKNDVDVLKMVREINLDHLQMLDKFESSNGHKHSPSERAEICQRDQKGNKRNVGDATSVVSVPKRRRSSSGHSPYKFSNSGPKVQLKASEDELHLESDMDKNVSLDSHDENSDQEKMLESISPRKRKKSLSSKLKITESDWALTDVERQSRSAGGGDSKLKSASGSMKKRKNVSGLAKCSTKENKLVNDELIGCRIEVWWPMDKRFYEGTVKSYDSTKQRHVILYEDGDVEVLNLKKEQWELIDTGGKTAKKSRTSKGNSKKKRSSGSKPKNPDGVQRDEDPVTTTPKGKRTPKKNLKQLHPKDTPKSLSLEHEKVESRNKKRRSSALPKTEYSGEAGEEKSESEGKSLKEGEDDEEVVNKEEDLQEAKTESSGDAEGKEAEHDDSDTEGKQENNEMEREAEENAETSDNETLGAWKSKVGKSISRTAI

SEQ ID NO: 196 - protein, 421 aa, Arabidopsis thaliana
MLVFENFCSRDDTVFCGVFDGHGPFGHMVAKKVRDTLPFTLLTQLKMTSESDQSSLVGANGFQIKCTEEEEVQTTESEQVQKTESVTTMDEQWCELNPNVNNDELPEMYLPLKHAMLKSCQQIDKELKMHPTIDCFCSGTTSVTLIKQGEDLVVGNIGDSRAVLATRDEDNALLAVQLTIDLKPDLPGESARIQKCKGRVFALQDEPEVARVWLPNSDSPGLAMARAFGDFCLKDYGLISVPDINYRRLTERDQFIILASDGVWDVLSNKEAVDIVASAPSRSTAARALVDTAVRSWRIKYPTSKNDDCTVVCLFLQDSSVAMEVSTNVKKDSPKEESIESVTNSTSKEEDEIVPVKDEKIPESCGIESKMMTMTLAECISVAQDDEEWSALEGLTRVNSLLSIPRFLSGELRSTSWRKWL

SEQ ID NO: 197 - protein, 1090 aa, Arabidopsis thaliana
MDSDASAKENTQDLSDYKGMIETGGEGSVRDELQEPGLMVKQREVKGVEASYAVKCANTTVKRKMDQHKEAMLGKKRNRQTRFLNLEDVKQAGTVNTSTPRRQNFAQAVPTRSSAVNPPAEHGGESQSQSHQNLKSVDFPSTGGIHSESAEQKTESNGESYSGLLGKPRRLNRDEEPSAEGMGTSVSRQASWKQPANIRQPKSGHSSSRKVSYSQRSFKKPATSSTQYQDTSVERLIREVTNEKFWRHPEDTELRSVPERFESMEEYVRVFEPLLFEECRAQLYSTWVELAEANTYVKVRIKSIERRERGWYDVILNSLNGCKWAFKEGDVAVLSTPLPESDEDHEDAGRVAGTVRRHIPVDTRDPRGATLHFYVGNSGGTGSKIDDSHILRKLKPQDIWHLTVLGSLATTQREYVALHAFSRLNPQMQNAILNPSPEQFPSYEEQTPATPDCFTTSFVDHLHRSFNAPQLAAIHWAAMHTAAGTSSGVKKQEPWPFTLVQGPPGTGKTHTVWGMLNVIHLVQYQQYYTSLLKKLAPETYNQANECSSSDNILSGSIDEVLQNMDHNLFRTLPKLCAKPRMLVCAPSNAATDELLSRVLDRGFIDGEMRVYRPDVARVGVDSQSRAAQAVSVERRSDQLLAISRDEILRHMRNLRLQETQISQNIAGLKRELNAAAFATRSQGSVGVDPEVLISRDQKRDALLQHLAAVVEARDKVLVEISRLLIVEGKFRAGNNFNLEEARASLEASFANEAEIVFTTVSSSGRKLFSRLTHGFDMVVIDEAAQASEVGVLPPLALGAARCVLVGDPQQLPATVISKAAGTLLYSRSLFERFQLAGCPTLLLTVQYRMHPQIRDFPSRYFYQGRLKDSESISSAPDEIYYKDPVLRPYLFFNISHGRESHRGGSVSYENVDEARFCVGVYMHLQKTLKSLGAGKVSVGVITPYKLQLKCLKHEFGNALGQDELKEIYINTVDAFQGQERDVIIMSCVRASGHGVGFVSDIRRMNVALTRARRALWVMGNASALMKSEDWAALISDARGRNCFMEMDSLPLDFPIPKVSSYNPMAPNNGLITSKLYPSDAPIIGLHTKLR

SEQ ID NO: 198 - protein, 1567 aa, Arabidopsis thaliana
MTTPITGKNSPVTGKEEGELSTSDDEVQPMQTSTRSPLTEHISANTNIQRRQAGNGGSFIKPSDATPTKLTNPGGRIFETKQAIAAIHGKKFPVRGNNSNLVINFSDDDSGSESDCKGRTQTSKIQPKGTISGNRNPSTFSQTKLKGPRQIDIRAITKKALSTSTFSHAATSKVSNLSFAKEMKSNKYIHSSERTVSKDAQRPEQIVESNSNKLQDLKQQIALRESELKLKAAQPKKDAVNPKITPARRVSIISDDTRHLEPNEPPKKRLKVSGIDTSQPVIDYRVAASAAAPMNAPDIRKSLLPGVNANSSCKHLGSKSDEIVPPVIPQHTVEGNTSSSVLQKSTGKVNHYEGGRELETMKNVDRSVSSEQLLKIVNGNHQVFSRSSNNNWKRLPCSNNSGLYNIPGSTTVPGHSQLDMLSLTNLEESLDKELEEAQERKRLFEIEERNALKVYRKAQRSLIEANARCAELYSKREILSAHYGSLIVRDSRLLWPSIHGENPETGFHFLNNSTGSIDLATKTDIAQHSQLESNHKYNSEYVGSHPPPHSRSGQNLGYSDLGASTSDGLPCGNKQTASRLCSPSSDANILPDDESFPVDHESTEGNPGHQKENIDQTLGNQNALLLEASLRSKLFDRLGMRAESRGGTCFNEETVIDRGDERDFGSEGTQRDNGSPFSEIYLHNDSLEPGANKLQGSPSEAPVERRSIEENSLNYQLSIDMESHRSSPENALLSSVALSGPLFRSTIYHLKVPGSSITSLGPEYILQNKTYSLYSDKRQCRSLTETIVYEKKIGFYTCNLKVDPSWPLCMYELRGRCNNDECSWQHFKDFSDDSLHQSLHDPDGRVGSSSHQKTHNSSKGSQILDSVFSPTYLVSLDTMKVDSWSYESVLAQRHGQIWCKHFSACLASSNSLYRNVPAKENEGRIVVLGNSKTYSSYFRIKHSLMWHIFQALSLLSQGLEGDPTSEILWAVYLLIYHAYEGSDGKDMFSYGVKHSSRSYVIWLMYINSRGQLNDQLIAYDTALSALCNHASGSIDRNHASACILDVLLQMFNLLCISGNVSKAIQRISKLQAPAAVSDDPDFSLMSHILTCLTYSDKFIYRKLPDSIIRRLEMEKELLEIEWPTVNLDGDLKQMALRLFDKGMRSVEHGTNNGIQKRPAGLFALNYALFMIAVDELESRRDILKASVQLYPTCLELKLLAVRMQSNELKDMFSSGFEELLKQEAKEASCIQCIWNQYAEYALEGGSYDLARELMSRWYGSVWDVLSHKYKTVRGNEEEGDDNMLESALSDLNVASDQVDVMFGYLNLSLHNLLQSNWTEARLAIDQALKATAPEHFMHCLREHAVFQLINELQATGEFSINLQMRLLNSYLDRASSLPVKEPLSWKFISNSAEKPRVRKLVTNLLAPVSSELFVVNVVLEAWHGPSLVPEKLSKQKELVDFVETILGLVPSNYPLALSVSKLLRKEEKQSDSGSSSGIHFWAGLNLASTISCAIPVAPEYIWVEAGEIVSDINGFKTRAERFLKKALSVYPMSVKLWRCYWSLCKSIEERRGIEIEEAARKKGITLA

SEQ ID NO: 199 - protein, 1678 aa, Arabidopsis thaliana
MPPGVRQLTVLGKFKPFGLIAEATDGKSPDDSYQYFLFDPELTGERDDADGNDANFSRQREHELFIRDNCNVRKGYALVEANFIGYWYNACWSNLGRGTEAFLCVLQIACLTIYNTSGEVVSVPLMRTVKSIWPLPCGLLLEQAGEVNPPSHVPFSPVSPILGSREMLRQRKEVGNSSPQNFHSPVAHDLISKRDMPCMSSHLILRDPLEEPGPTYVEERGKLTIMKDYDERTIWTSDRLPLMTSYNKGKMQHSVWAAEFIESNLEASASCSSGIVPDAVLSKRVSFRRIWQAKGAKKAASKVFLATDNSVPVICFLILEQKKLLSVGLQTVEINNEILFDVKPDISWSVSAIAAAPVVVTRSQVKIGLLPHLDIIVLSPENDLFLYSGKQCLCRYVLPSWLGESIGSGDGESAKTDSGFRNLKITGLSDAVLGSINLSVNHSQIFRCALTGKPSSSLANDCIAAIAEGLRSDLYSLFLSLLWGDGHSDLQGSSIHFEWEALCNIFLEICQKPTVVHRKQPKTASESSWEFLLISKFHKTYSRFHNGITSINRLDLEGIVPFDSKICSEETLGSSCELMVQSLDCLHAVYESLKMDNLRKQDLHHLAVLLCNIAKFLDEKCYLDYYIRDFPRLSTTIGACTTLSSSRKPPNLFRWLENCLRRGCLSTNFDDLPDLIRRDGCSIVSWARKVVSFYSVLFGDKPEGRTLSSGVPCNIAPGSYSCNEELTILAMAGERFGLHQLDLLPSGVSLPLRHALDSCRESPPADWPAIAYVLLGREDMALSVFRNFSSSKEFEMQSNTSLISMSIPYMLHLHPVIVPSSESIGLENTKIEDTNSVDGSVIDGMEHIFNSYTQLRYGRDLRLNEVRRLLCSARPVVVQTAANPTISDQEQQQAFTVPKLVLAGRLPSQQNAIVNLDPNIRNIQELKTWPEFHNAVAAGLRLAPLQGKVSRTWIRYNKPGEPNAVHAGLLFGLGLQGYLHVLNLSDIYQYFTQDHESTTVGLMLGLAASYRGTMQPDIAKALFFHVPARYQASYTEFEIPTLLQSAALVSVGMLFEGSAHQQTMQLLLGEIGRRSAGDNVLEREGYAVSAGFSLGLVALGRGGDALGSMDSLVNRLLLYLGAKEERSILVPSLEDHRSAAQITDGSTSNVDITAPGAIIALTLMYLKTESEVIFSKLSIPQTHYDLECVRPDFIMLRVIARNLIMWSRICPTCDWIQSQVPEVVKNGISQLRDDMDNMYEVDVEALVQAYVNIVAGACISLGLRFAGTRDGNARDLLNSYALYLLNEIKPLSATPGNAFPRGISKFVDRGTLEMCLYLIIISLSVVMAGSGDLQVFRLLRFLRSRNSADGHANYGTQMAVSLATGFLFLGGGMRTFSTNNGSLAMLLITLYPRLPSGPNDNRCHLQAFRHLYVLATEARWLQTIDVDSGLPVYAPLEVTVKETKLYSETKFCEITPCILPERAILKRICVCGPRYWPQQIELVFGLRTLGESNLIANSHRELDSDSVDHLVSTFSSDPSLIAFAQLCCDKSWNNSFDFLILDLILWSQVALAYNEAVSTGRLASSGGFVQSIFLASLRKRCEEVLNCSTELKINLRNYLTSEAWPYDKNSKLQKDIIILSWYLKWFNVPSPSIIKAAVEKIKSKSKNSTSAIPLLRLLLPNTHISVIGEIDRVFFPSN

SEQ ID NO: 200 - protein, 118 aa, Arabidopsis thaliana
TKNLNPMFLFFTMRILKTQRSRGGRRTSKKFGNRRTSGGEKFSEKLQALKSLLPPPSKMTEQSRQDAYVEEDSSVGETEQLFQETADYIVRLRGQVVVLQKLIEIYGSSDQKEDNFVS

SEQ ID NO: 201 - protein, 1263 aa, Gossypium hirsutum
PLYPFLYFSYNKKKMTPSAGSFSGDRDDDGDATKKKKKQRKVPLLKLFSFADFYDHVLMGLGSLGACVHGASVPVFFIFFGKLINIIGMAYLFPKEASHKVAKYSLDFVYLSVAILFSSWIEVACWMHTGERQAAKMRMAYLKSMLNQDISLFDTEASTGEVISAITSDIIVVQDALSEKVGNFMHYISRFIAGFSIGFARVWQISLVTLSIVPLIALAGGIYAYVATGLIARVRNSYVKAGEIAEEVIGNVRTVQAFAGEERAVKSYKDALMNTYTYGKKAGLTKGLGLGSLHCVLFVSWALLVWFTSIVVHKNIANGGDSFTTMLNVVISGLSLGQAAPDISAFIRARAAAYPIFEMIERNTVSKTSSKTGRKLSKVEGNIELKNVSFSYPSRPDVVIFDRFCLNIPTGKIVALVGGSGSGKSTVISLIERFYEPLAGEILLDGNNIKGLDLKWLRQQIGLVNQEPALFATTIRENILYGKDDATVDEITRAAKLSEAIAFINNLPDRFETQVGERGIQLSGGQKQRIAISRAIVKNPPILLLDEATSALDAESEKSVQEALDRVMVGRTTVVVAHRLSTIRNADVIAVVQNGKIVETGTHDELISNPNSTYSSLVQHQETSPLQRYPSQGPTLSRPLSVSYSRELSRTRTSFGASFRSERDSVSRAGADGIDAGKQPYVSPGRLYSMIGPDWYYGFFGTVTALIAGAQMPLFALGVSQALVAYYMDWETTCHEVKKIAILFCCASVITVIVHAIEHLCFGIMGERLTLRVREGMFSAILKNEIGWFDDLNNASSMLASRLETDATFLRGVVVDRTSILIQNVGLVIAAFIIAFILNWRITLIILATFPLIISGHISEKLFMQGYGGNLSKAYLKANMIAGEAVSNMRTVAAFCAEEKILDLYARELIEPSERSFKRGQIAGIFYGISQFFIFSSYGLALWYGSVLMGKELASFKSVMKSFMVLIVTALAMGETLALVPDLLKGNQMVASVFEIMDRKTQVVGDAGEELTNVEGTIELKGVHFSYPSRPDVVIFKDFDLKVRSGKSMALVGQSGSGKSSVLALILRFYDPTSGKVMIDGRDIKKLKLKSLRKHIGLVQQEPALFATSIYENILYGKEGASESEVVEAAKLANAHSFISSLPEGYSTKVGERGVQLSGGQKQRVAIARAVLKNPEILLLDEATSALDVESERVVQQALDRLMRNRTTVMVAHRLSTIKNADRISVIQGGRIIEQGTHSSLIENRNGPYFKLINLQQQQQMEQ

SEQ ID NO: 202 - protein, 65 aa, Arabidopsis thaliana
MAASLSNFSVLASEIKPTGRVDNQCKEMCSATFGDGKCAADCRKAGFSSGRCLTSSPFGNKCCCT

SEQ ID NO: 203 - DNA, 1388 bp, Raphanus sativus
gggacttcccagtctttctcagctctcactctcactctcttccacaacaacacagatcttcacttttccatagatcggagtagtgaggctagaaagaaacactaagaaactgtaatggatctttcttctcttcgcggctcgtcttctctgacactgagcttcatagttctgcccttagcttccacaggttcgtacggttcaaccttcacattcgctaaccggtgcggcttcaccgtctggcctggaatcctagcgaatgccggctcacctactctctccaccaccggttttgagctccccaagggcacctcacgctctctccaagcccccaccggctggtccggtcgtttctgggctcgtaccggctgcagcttcgacggttccggctccggtacctgcaaaaccggagactgcggctcaaaccaagtcgaatgcgtcggactcggcgccgcgccgccggtgactctcgccgagttcactctaggcaccggaggagacgacttttacgacgtcagcctcgtcgacggttacaacttccgatgatcgtcgaagtcgccggtggatccgggcagtgcgcttccacgggctgcacttccgaccttaacctccagtgtcccgccgagcttcgctccggcgacggtgacgcgtgtagaagcgcgtgcgagcgtttcggagtcctgagtactgctgcagcggcgcgtacgcaacgccgtctacttgtaggccttcggtttactcggagatgttcaaagccgcgtgtcctcgctcctacagttatgcttacgacgatgctacgagcactttcacttgcgccggkggtgattatacggtgacgttttgcccttcttccccgagtcagaaatcaacaagctacccaacgccggtatcagactcgtcgkcgacctcacaaggytccgaccccgtkcccggttcggatacgggttactcwggtcaaggtcaacaacagtctcaaggtcagggtcaacaacargctcaagctcaaggtcagggttatgcgtatgggtctcagggaaccggrtcgcagggggagacgatgttacaagacggatcatggatggctggtttggccatgggagactcgagcagrttagccggcacttcactagcaatgctactcgctggatwtacctttgtgtttccgtttattttctcgtagcatcatcrtctttgactttcycttgcatttgcatttgtttaatgttagactgtctttgttgataatcagttttttttcyctcaagtaggactgcaacaatttgggttytaggttrttttgtattgrarctttgtgtgygagtctgttcttgctycatctgtctttgaagactgtttggttcatgttcgacattgtgagatatgttttgtga

SEQ ID NO: 204 - DNA, 1799 bp, Raphanus sativus
ggaaatttgcttttattgttgtctttctccttctctcctctgctttgagactgtgactccacttctctctttctctcctctctcaagattgcattacactagtactgaatgactcttcttctcttctattgcttcttaacctctctttctcttgctcatggagcttcactcattcacatttcccctactcagcctcccacagcttatgagaaaaccatttgggaaaattctacaaagaaatttatagtggcagaaacgycattatatggacctacttacaataaccctcaagtgattggagaygcttcagtggctttagctgctcaaakaacattcagaaaagatcctctcaatggtttccagatatatactggaggatggaatatcagcaaccaccattactgggcctctgtgggctatacagctggtcctctctttgctgttgctgcygtttggtttcttgggtttggcatctgcttattggttatatgcatgtgtcacatatgccatagaagcacatctattggatactcaagagttgcttactttctctccctcatcttcctcctcttcttcactcttatggcaataattggatgtgttatgctatactcgggtcagataaggtacaatgaaagcacgacagagacattagcttatgtgatgagccaagcagatagcacggtttcacagcttaaagctatatcagattatctcacatcagcaaggcagattggagttcttcatgtgwctttacctscaaaygtccaaacygaaatcgatcagatcggagcaaaactgagtacttcaatagctaccatcactgacaaagccactagtagctccaataacataagaaatttccycaaytccgtgagggtggcacttatagtagtttcaattgtcatgcttattttgacatttctyggtctcgcttcttcaatctttgggatgcaagtcatcgtttacacccttgtgatccttggatggattttggtgactggtactttcatcttgagcggaacgttccttctgctrcacaatgcaactgcagacacatgtgtggcaatgagtgaatgggtagagagaccctcaagcaacacggctctagacgagatcttaccttgtacagacaatgctacagctcaggaaactttgatgcgtagcaaagaggtgacagggcagctcgtggagctcatcaacacagtcgtatctaatgtctccaacatcaacttctctccagtctttgtccaaatgtactacaaccaatctggaccgttgcttcctttgctctgcaatcccttcaaccatgacctcaccgatcgcccttgctcccctggtgagctcgatttgaacaatgctactcaagcatggaccccttttgtgtgccaagtaaaccagaacgggacttkcataacaacagggaggctcaccccggcgctgtatggtcagatggcatcatgcgtraacatcagcacagggttgatcaacgacgcaccgttcttggttcagcttcaggattgttcatacgcaaagcagaccttcagagacataaccaataacaactgtccaggactcagacgttatggttacagagtctatgtgggtctggccatgttatcgaccgctgtgatgctctcgcttgtgttctggatcatctacagcagagagagacggcaccggaagcaagctttgcctgaatattcagaaagtaaggagatcgtaagagttaacttctgaaatgtatctctctctccatgtattggacgttaacgttgtgagagaaatgcaaaatatta

SEQ ID NO: 205 - DNA, 2460 bp, Brassica napus
acactccctcttctctcttccatctgtacgtctctcgcctgccttattatttcagcgytttttagctgataatctcgccggcatttctcttctctctttggtkaagttatgragaaktttgcgtccgtggctgcyctrctactgcttctytsttttccggtagctttctcyggtcatgattacggccaagctctttcyaagagtctyctcttcttcgaagctcagagatctggtgtcctccctcgtaaccaaagagtcacttggcgctctcactccggtctcaccgacggcaaatccagcggcgtgaatctggtcggaggttactacgacgccggagataatgtgaaatttggacttccgatggctttcacggtgacgatgatggcgtggagcgtcattgaatacggcaaycagttagcggccaacggcgagctaggccactccattgatgccattaaatggggtactgattacttcatcaaagcccatcctgagcccaacgtcctttacggcgaggttggggacggcaacaccgaccactactgttggcagagaccggaagaaatgacgacggacaggaaagcttaccggatagatccgagtaatcccgggtcggatctagcgggagaaacagcagctgctatggccgcagcttcgatagtcttccgccgatctaaccctgcttactctaggcttctactcactcacgcttatcagctgtttgatttcgcggacaaatacagaggaaaatacgacagcagcatcaccgtcgctcgtaaatactacggatccgtcagtggttacaatgacgagttactctgggctgccgcgtggctataccaagcatccaacaaccagttctacttggactacttgggtcgtaacggtgactycatgggtggtaccggttggtccatgaccgagtttggttgggacgttaagtacgctggtgttcaaacccttgtcgccaagttcttgatgcaagggaaagcaggacgtcacacggctgtgtttcagaagtttcaacagaaagctgatttctttatgtgttccttgttgggtaaaggctcccgaaacattcagaagactcccggtggtttgattttccgacagcgttggaacaacatgcagtttgtcaccagcgcttccttcttgaccaccgtttactctgattacttaacttcctctcgaagctacttgagatgctctgctggcaacgtcgctccttcgcagcttctctcctttgctaaatcacaggttgattatattcttggagataacccgagagctactagctacatggttggttacggtaacaacttccctcagagagttcaccaccgtggctcctccatcgtctcttacaaggttgaccgctcttttgtcacctgccgtggtggttacgccacctggttcagccgtaaaggcagtgatcccaacctcctcactggcgctattgtcggcggtcctgatgcttacgacaatttcgctgacaggagagataactatgaacagactgagcctgctacttacaacaatgcaccgctccttggtgttcttgctcgtctcagcagtggtcattccggttacagccagcttcttccagcggttcctgctcctgttgttgtccgaagaccaatgcctattcgtaaaccgagagtgacttccccggtccgagcttctggtccagtggctatagttcagaagatgacaggttcatgggtctcaaagggaaggacttactacagatactcaacaactgtaacaaacaaatcaccaagagctctgaaaagtcttaacctgtcaatcaagaatctctacggaccaatctgggggctctctagatcaggaaactcattcggtttaccttcctggatgcactcattgcaatccggaaagtccctagagttcgtctacattcactctacaacgcccgccaatgtcgcggtttcaagctacacgttggcttgaccagacaacaaacttcgaaaggaatcacagtgtgtatagggtcgtgagaagaaagtgttggtttttccctatggttcatcaagaacgtttgaaggtttggtctttttatttttattttgctttttttttcgggtgaatatagaagggttgaagaaaggtggaagaaaggtgtgaagagacagtcaaagactcttcggaaaatttagaagaagagtgaaagtgctcatcctctttctactcctagttcaatgctttttaaaaattatatatagtgagagagagaggaagataggaaaaaaagatagtgttttgtgagatcttccttctcttaaaaagggtctctcttgtgagattttgcaaggattgttttttcattccttgtagctcaaaaaaacatgtgtatgcctttgtccttttgtgtttttatctttcttggtggtcagttgtaaaactcaacaacagtacttaagtgaaatgtgatttggttat

SEQ ID NO: 206 - DNA, 2466 bp, Raphanus sativus
ggacactccctcttcttcttccatatctacgtctcttgtctgccttattattcagcgctttttagctgttataatctcgcaggcatttmtcttctctctttggttaagttatggagaaatttgcatcmgtgactgctctgttactgcttctctgttttccagtagctttctccggtcatgattacggccaagctctktcyaagagtcttctcttcttcgargctcagagatctggtgtcctccctagtagccaaagagtcacttggcgctctcactccggtctcaacgacggcaaatccagcggcgtgaatctggtcggaggttactacgacgccggagataatgtgaaattcggacttccgatggctttcacggtgacgatgatggtgtggagcgtcattgaatacggcaatcagttagcggccaacggcgagctaggccactccattgatgccattaagtggggcactgattacttcatcaaagcccatcctgagcccaacgtcctttacggcgaggttggagacggcaacaccgaccattactgttggcagagaccggaagaaatgacgacggacaggaaagcttacaggatagatccgagtaatcccgggtcggatctagcgggagaaacagcagctgcgatggccgcagcttcaatagtcttccgccgatctaaccctgcttactctagcttctactcactcacgcttatcagctktttgatttcgcggacaaatacagaggaaaatacgacagcagcatcaccgtcgctcgtaaatactacggatccgtcagtggttacaatgacgagttactctgggcagctgcatggctataccaagcatccaacaaccagttctacttggactacttgggtcagaacggtgactccatgggtggtactggttggtccatgaccgagtttggttgggacgttaagtacgctggtgttcaaacccttgtcgccaagttcttgatgcaagggaaagcaggacgtcacacgcctgtgtttcagaagtttcaacagaaagctgatttctttatgtgctccttgttgggtaaaggctccagaaacattcagaagactccyggtggtytgatcttccgacagcgttggaacaacatgcagttcgtcaccagcgcttccttcttgaccaccgtttactctgattaccttacttcctctcgaagctacttgagatgctctgctggcaacgtcgctccttcgcagcttctttcctttgctaaatcacaggttgattacatycttggagataacccaagagctactagctatatggttggttacggtaacaatttccctcagagagttcaccaccgtggctcctccatcgtctcttacaaggttgaccgctcttttgtcacctgccgtggtggttacgccacctggttcagccgcaaaggcagtgatcccaacctcctcactggtgctattgtyggcggtcctgatgcttacgacaatttcgctgacaggagagacaactacgagcagactgagcctgctacttacaacaatgcaccacttcttggtgttcttgctcgtctcagcagtggccattctggttatagccagcttcttccagtggttcctgctcctgttgttgttcgaagaccaatgcctattcgtaaaccgagagtgacttccccggtccgagcttctggtccagtggctatagttcagaagatgacaggttcgtgggtgtcaaagggaaggacttactacagatactcaacaactgtgattaacaaatcacctagacctctgaaaagtctcaacctttcgatcaagaatctctacggaccaatctggggactctctagatcaggaaactcgttcggtttaccttcctggatgcactcattgcaatccggaaagtccctagagttcgtctacattcactcaacatctcccgcaaacgtcgcggtttcaagctacactttggcttgaccagacaacaactacttcaaaaggaatcacagtgtgtataggtcgtgagaagaagaagaagaaagtgttggtttttcactctgtttcgtcaagaaggtttaaaggtttggtctttttattttcattttgctttttcgggtgaatataraagggttgaagaaaggtgtgaagaaaggtgtgaagagagtgaatgactcttcagaaaatttagaagaagagtggaagtgctcatcctctttctactcccaagttcaatgctttttaaaatttatatatacatagtgagagagaggaagatagaaagaaggatagtgttttgtgagatcttcctttctctttagaaaaagggtcgtgtgagattttgcaaggattgtttttcattccttgtacctcaaraaaacatgtgtatgcctttgtccttktgtgttttatctttctaggtgatcaagttgtaaaactcaacaacagtccttaatgaaatgtgatttggttat

SEQ ID NO: 207 - DNA, 772 bp, Brassica napus
ccgggcgaggattcggacgaggagaayagwgctcaacaggcatggragaraaagasaagaaaakcaagaagatcaagaagaagaaagataccaaatcctcgccggacatctccttcaaaccttcctccgccgtcaaaggcctcaaattcggcggccagataatcgtcaaatcattcacaatccggcgagcaagaacactcgagctcctcaaactcctctccctcccttcttcatcatcaccatctccgccgcttctttccacggctgcgtatcttccgaccaacttcacgatcttagctcaccaagcgtggcacacactaaccctcgggctaggaacaaggaagtccaaagtggttgtcttcgtgttcgaaacggaggcgatgaagacggcggtyrcggcggcggwgggrggaytmtggccgtcggagattcckctcggygaagtgaacaagaagatgatmagaaasttaaagaactgggagatggcgaggttcaagttcaggaaaggatgcytaacgttttacgtmtacgccgtgagaaacgccggarrcgarggktttgcggcggcggaggacttaaaggtaattttacaggcggtggtggctttgaaagacttcatggatcayacggcgatgctagtaatgccccaccagaaagcwattaattacagttcttgccctccttttgccatggctcactaggataattgaactggccctcttcttttcattattttgactgtcttatttattttcaatatacaacaaatagt

SEQ ID NO: 208 - DNA, 1533 bp, Malus domestica
cacgaggatttttccttccttttttctccttatagttttcaggaggagggataggaaaagccatgctattcactagaatcgatttaaagcttctcagttataaatcaagtaaaaaaaatacaactaaatcgtaatattaaatgattattattattattatatatttttaagatccttacatcgtattttataaataaacgaacctgtaatccataatttcattaaaaaaacggagggagagagagtgtgaataaccaaactctatataattagtggtcagctgtttgggggtttgttattggaggttctaagtgacagcgcgtttggtggaggaatagtaacgacagcagagaaaaaaatggatcacgcagccgatgctcaccggacggacttgatgaccctaacgaggttcgtgctgaatgagcagtccaagcgccctgagtctcgcggtgacttcactatcttgctcaatcatattgttcttggctgcaagtttgtctgctctgcagtcaacaaggctggtctggccaaacttatcgggcttgctggagagaccaatgttcagggtgaagagcaaaagaaactggatgttctttcaaatgaagtttttgttaaggctctggttagcagtggcagaacctctattcttgtttcagaagaagatgaagaggcgattttcgtggagccaaaattgcgtggaaagtactgtgttgtgttcgatccactggatggttcgtcaaacattgattgtggtgtttccattggaacgatttttgggatttatgtggtaaaagatggtgaaccttctcttgacgatgtcttgcaacctggaaagaatatggttgcagcaggctactgcatgtacggaagctcttgcacgttggtgataagcactggatctggagctcatgggttcacccttgatccttctctcggggagttcatactaactcacccagacatccagattccaaagaaaggaaagatttattcagtgaatgaagggaatgccaaaaattgggatggcccgacagccaagtatgtgcaaaagtgcaagtacccggaagatggttcatccccgaagtcgctaagatacattggaagcatggttgctgatgttcatcggacattgctgtatggcggtatctttttgtaccctgctgataagaagagtccaaacgggaaactgcgggttctctacgaagtcttcccaatgtccttcttgttggaacaagcgggcggtcagtccttcactggcaaggaacgggcccttgacctggttccgaccaagatacacgagcgctctccgatcttcctcggcagctacgacgacgttgaggaaatcaaggcactctatgcagctgagggaaaggaatgaaacttagaattctggttctctcatcgtaaatcacataattgttaatctatttgaactcctctattagatgaagtttgtatggagagcgtacaataatttgttgatgcttacaactctaacaaggttatcgtcttatattctggagaaaaaaaaaa

SEQ ID NO: 209 - DNA, 1357 bp, Aquilegia formosa
cacgtgtcattcaattcttccattgaccattagatagccctatctccttcttcttcttcttgttcgttcgtatatatctttaatccaatcttttttctttgtttttgaatttagaaaaaaaaaacatcaaagtttgaatttttttttttattgattgaatcaaaagaatttgagcaccatggatcacgaatcagcaactcataatactgatattatgactattactcgacatgttttgaatgagcaatctaagtatcctgaatctcgtggagatttttcaatcttgcttagtcacattgttcttggttgtaagttcgtttgtagtgctgttaacaaggcaggacttgctaaactcattggacttgctggagagactaatgttcagggtgaagagcaaaaaaaactagatgtgctatcaaatgaagttttcgtcaaagctttagtaagcagtggtcgaacgtgtattttggtttcagaagaggatgaagaagctatttttgtggagccttcaaagcgtggaaaatattgtgttgtttttgacccgttggatggatcctcaaacattgactgcggtgtttccattggaactatatttgggatttatatgataaaagatggaggtgaaccaattctcgaggatgttttgcaatctgggaaacatatggtggctgctggctattgtatgtatgggagctcttgtacgtttgtgttgagcacaggaagtggtgtcaatggctttacactcgatccgtctctaggggagttcattatgactcatccagatatcaagataccaaagaagggtaaaatctattcagtgaatgaagggaatgccaaaaactgggatggaccaacaaccaagtatgtggagaaatgcaaatttcctacagatggttcgtccccgaagtctcttagatacataggaagcatggtggcagatgtccaccgaacattactttatggaggtgtctttttgtaccctggggataagaaaagcccaaatgggaaactacgtgttctctatgaagttttcccaatgtcgttcttgatggaacaagcagggggtcaagcttttacgggcaaagaacgggcacttgacttggttccaaagaagatccatgagcggtctcctatattccttggcagctatgacgatatcgaggaaatcaaagcgctctatgctgctgaacaaaagacagcataagtatgcaaatcccaataatattctatagtttctttcatctattactttctcataagctatgaagcctcgttgtaatatgaggatacattttatggatgaaaaggaagaaaatccagttttcaatttctgaatcaaattgttgggtatgaggat

SEQ ID NO: 210 - DNA, 1704 bp, Artemisia annua
actagttctagtcgcgagcgcgccttatttttttagagttttgaaaaaaaaaaagtttgttcaagatggatcatgaagcagatgcgtttaggacagatttaatgacgatcacacgattcgtgttgaatgaacagtcgaaacatccggagtcacgtggtgattttagtattttgcttagtcacattgttcttggttgcaagtttgtttgtgctgctgttaataaggcgggtttggctaaactcattggactcgctggagagaccaatgtgcagggagaagagcagaagaaactggatgttctttcaaatgaagttttcgtgaaagctttggtcagcagtggcagaacatgcatacttgtttctgaagaggatgaagaagcaataattgtggaaccatctaagcgtggaaagtattgtgttgtgtttgatccactagatggatcctccaacattgactgtggcgtttccattggaactatttttgggatttacatgataaaagacggtgatgatccatctttagaagatgtactgcagcctggaaagaatatgctggctgctggatactgcatgtatggtagctcttgcacgtttgttttgagcactggatctggtgtgaatggttttactcttgatccatcactaggagagtttatactcacccacccggacatcaagatcccaaagaaaggaaagatctattcggtcaatgaaggaaatgctaagaactgggacggtcccactgcaaagtttgtggaaaaatgcaagtaccccacggatggttcatctgccaaatcattaagatatattggaagtatggttgctgatgtccatcgcacattactttacgggggtgtgtttttgtaccctgctgataagaagagcccagatgggaaactaagggttctgtatgaagtgttcccgatgtcgttcttgatggaacaagctggaggacagtcgtttactggaaaaatacggtcacttgacttggttccaaagaagattcacgagcgatcccccatcttccttggaagctatgacgacgtggaagaaatcaaggcattgtatgcggctgaagagaaggcataaagaaagagagctagttaagggtaattgatctcatctccatgttcttgtgcaggttctatttgacatttctttgtttataaaaccatgctccactctttgttcccttttttcatatatgtaataaaaaggctaccttttaatcaatagttttgaactgttgtagacagtagtcgcggagtcagaacatttattaagagcgccgaaattctaaatgttattaattttcatttcggaaattccttttgcactcgtcaaaaagacgactgaaagttcaagtttaagttttgacaaatttgatgatccaagtttttttatcccgacgaatgttcccgtttgttataattgtttcatagtccctctgatgagccaacaaagttttgaatattctgcaacacatttgcatattatgttacatttctcttgacaattttcaagttttatgttagttagaggaaaggccttactccttagttattacttataaaactctaaagtagctccatcaagtaataatgttaaatacaagtagtcacactttttgactacttttgatccatattacatgtcatggatcctcaataatgttaaatacaatttgttacacttttcaaaaaaa

SEQ ID NO: 211 - DNA, 1148 bp, Brassica juncea
actttgatcagtagagagaaagagagagagcacgaagcagatgcataccgtacggatctgatgaccatcacgaggttcgtgctgaatgagcaatcaaagtacccagagtctcgtggggatttcaccattttgctaagcaacatcgttttgggatgcaagttcgtctgcagtgctgtcaacaaggctggtttggccaagcttattggacttgctggggaaacaaatatccagggtgaagagcaaaagaaactcgatgtgctctccaacgatgtctttgtcaaagctttggttagcagtggcagaacctctgttcttgtctcagaagaagatgaggaagctacgttagtggagtcatccaagcgtggaaagtactgtgttgtttttgatccacttgatggatcctcaaacatcgactgtggtgtctccattggaaccatctttgggatttacacaatgagccacaatgatgagccaactactgaagatgtcttgaaacctgggcatgaaatggttgcagcgggttactgtatgtacggaagctcctgcatgcttgtgttgagcactggaaccggtgtcaatggatttaccctggacccatctctaggagagttcatattaactcacccggacattaagattccgaaaaagggaaacatctattcagtgaatgaaggcaatgctcagaactgggatggtccaaccacaaagtatgtagagaaatgcaagtttcctaaagatggttctcccgctaagtctctgagatatgtgggaagtatggtagccgatgttcatcgcaccctgctttatggaggaatcttcttgtacccggctgacaagaaaagccccaatgggaaactgcgtgttctgtatgaagtcttcccgatgtcgttcttgatggagcaagccggaggacaggccttcactggcaagaaaagggcgctagaccttgtgccggagaagatccatgagcgttctcctatatttcttggtagctacgaagatgtagaggagattaaggctctgtatgctgcagacgaatagaagaaataagattctcactcttcttatttcatcactcttctctcttatatctatgtcttcttctgttgagacaaacaaatgactcatttatacaagggagacttttt

SEQ ID NO: 212 - DNA, 1190 bp, Brassica oleracea
  misc_feature (1172)..(1172): n is a, c, g, or t
ggagagagagagaaagggagaggatcaaagatggatcacgaagcagatgcataccgtacggatttgatgaccatcacgaggttcgtgctgaatgagcaatcaaagtacccagagtctcgtggggatttcaccattttgctaagcaacatcgttttgggatgcaaattcgtctgcagtgctgtcaacaaggctggtttggccaagcttattggacttgctggggaaacaaatatccagggtgaagagcaaaagaaactcgatgtgctctccaacgatgtctttgtcaaagctttggttagcagtggcagaacctctgttcttgtctcagaagaagatgaggaagctacgttagtggagtcatccaagcgtggaaagtactgtgttgtttttgatccacttgatggatcctcaaacatcgactgtggtgtctccattggaaccatctttgggatttacacaatgagccacaatgatgagccaactactgaagatgtcttgaaacctgggaatgaaatggttgcagcgggttactgtatgtacggaagctcctgcatgcttgtgttgagcactggaaccggtgtcaatggatttaccctggacccatctctaggagagttcatattaactcacccggacattaagattccgaaaaagggaaacatctattcagtgaatgaaggcaatgctcagaactgggatggtccaaccacaaagtatgtagagaaatgcaagtttcctaaagatggttctcccgctaagtctctgagatatgtgggaagtatggtagccgatgttcatcgcacactgctttatggaggaatcttcttgtacccggctgacaagaaaagccccaatgggaaactgcgtgttctgtatgaagtcttcccgatgtcgttcttgatggagcaagcyggaggacaggccttcactggcaagaaaagggcgctagaccttgtgccggagaagatccatgagcgttctcyaatatttcttggtagctacgaagatgtagaggagattaaggctctgtatgctgcagaggartagaagaaataagattctcattcttcttatttcatcactcttctctcttatatctatgtcttcttctgttgagacaaacaaatgactcatttatacaaaagagactttttctcattttttcaatgcanctaagatatttttttttc

SEQ ID NO: 213 - DNA, 1509 bp, Brassica rapa
agattaaacatttatctatccaccaaaaccattttagaaagagaaaaaaaaagaaggaaagaggccgaaactttataataatgttaatcgtgggagggcgagagacgatgaggggattgcatcagaagatacgaggacaaggttccttctttatcgttatccccacgaaaagacggccaaacctgtcacagccacgtgtcaatccgatctagtaagtctctccttggattggctcgttcgttggatttatcaccgatcgcgtctttatctaatcatcttcctcgaaacctgcaacacacaaaaaagaataaggcaatctctaaaacataaaaaggcatttggtggcgtagacgagagagagagagagaggatcaaagatggatcacgaagcagatgcataccgtacggatctgatgaccatcacgaggttcgtgctgaatgagcaatcaaagtacccagagtctcgtggggatttcaccattttgctaagcaacatcgttttgggatgcaagttcgtctgcagtgctgtcaacaaggctggtttggccaagcttattggacttgctggggaaacaaatatccagggtgaagagcaaaagaaactcgatgtgctctccaacgatgtctttgtcaaagctttggttagcagtggcagaacctctgttcttgtctcagaagaagatgaggaagctacgttagtggagtcatccaagcgtggaaagtactgtgttgtttttgatccacttgatggatcctcaaacatcgactgtggtgtctccattggaaccatctttgggatttacacaatgagccacaatgatgagccaactactgaagatgtcttgaaacctgggcatgaaatggttgcagcgggttactgtatgtacggaagctcctgcatgcttgtgttgagcactggaaccggtgtcaatggatttaccctggacccatctctaggagagttcatattaactcacccggacattaagattccgaaaaagggaaacatctattcagtgaatgaaggcaatgctcagaactgggatggtccaaccacaaagtatgtagagaaatgcaagtttcctaaagatggttctcccgctaagtctctgagatatgtgggaagtatggtagccgatgttcatcgcaccctgctttatggaggaatcttcttgtacccggctgacaagaaaagccccaatgggaaactgcgtgttctgtatgaagtcttcccgatgtcgttcttgatggagcaagccggaggacaggccttcactggcaagaaaagggcgctagaccttgtgccggagaagatccatgagcgttctcctatatttcttggtagctacgaagatgtagaggagattaaggctctgtatgctgcagacgaatagaagaaataagattctcactcttcttatttcatcactcttctctcttatatctatgtcttcttctgttgagacaaacaaatgactcatttatacaagggagactttttctcaaaaa

SEQ ID NO: 214 - DNA, 1220 bp, Musa acuminata
ggcacgagaaagattgaggagaagcatcggctgggcggagagagagactggtggttgcgatggatcacgaggcggaggcgcatcggacggacctgatgacgatcacgaggtacgtgctgaacgagcagtcgaggcaccaggaatcacgcggcgacttcaccatcctgctttcccacatcgtcctcggctgcaagttcgtctgttccgccgtcaacaaggctgggctggctaagctcataggacttgctggagagacgaatgttcagggagggagcaaaaggaagcttgatgtgctttcgaatgaagtctttgtcaaagctttgataagcagtggccggacttgcatcctggtgtcggaggaggatgaagaggcaacttttgtggatccatcgctacgtggaaaatattgtgttgtctttgatcctctagatggttcttcgaacattgattgtggtgtctctattggaacgatatttggcgtttacatggttaaagataaggacaatgtaaccctagacgaggtactgcaaccagggaagaatatgctagcagctggctattgcatgtatggaagttcttgcacgcttgtactgagcaccgggagtggtgtcaatggtttcactctagatccatctcttggggaattcatactgacccatccagatattaagataccgaagaagggcaaaatatattcagtgaatgaaggaaatgccaagaattgggatgggcctacaacaaagtatgtggagaaatgcaagttccccaaggatggagactcaccaaaatctctgagatatattggaagcatggttgccgatgtacatcgtacactgctttatggaggcatctttttataccctgcggataagaagagtccaaatgggaaactacgtgttctatatgaagtatttccaatgtcattcctgatggaacaagcagggggtcaagcttttactggcaagcaacgggctctcgatttggttcccacgaagatacatcagaggtcgcccatctttcttggcagctatgatgaggtcgaggaaatcaaagcactgtatgctgctgaggagaacactgcttaatttaaagatgcttctgtggagtcgaactaatcatgtaacctgtcattataataaatcttctcacctgtaaagcacggagtaaaacttgcttcaagtaatgtaagcacaaggcattgagaatacctttttccttcc

SEQ ID NO: 215 - DNA, 1500 bp, Hordeum vulgare
cccggggcctgtgctctgcaaccgcaagcaaagcaacacgtacgctaagcgagcgggagggggagggcggggttggtcggagccggagaagatggatcacgcggcggacacgttccggacggacctgatgaccatcacgcggcacgtgctcaacgagcagagcaggcacccggagtcgcgcggcgacctcaccatcctcctctcccacatcgtcctcggctgcaagttcgtcgcctccgccgtcaacaaggccggcctcgccaagctcaccggcctcgcaggcgagaccaacgtccagggggaggagcagaagaagctggacgtgctctccaacgaggtgttcgtcaatgccctcgtcagcagcggccgcacctgtgttcttgtgtccgaggaggacgaggaggctacgttcgtcgacccaaagctccgtggaaagtactgtgtctgctttgatcccctggatggctcctccaacatcgactgtggcgtctccattggaacgatctttgggatctacatgatcaagaaccaagacaccgtgactctggaggaagtgctgcagcctgggaaggacatgattgctgctggatactgcatgtatgggagttcctgcacgcttgtcctgagcactggaaatggtgtcaacggcttcacgcttgacccttctcttggggagttcataatgactcatccagacatcaagataccgccaaaaggaaagatctattcggttaatgaagggaatgccaagaactgggacacgcctactgcaaagtacgttgagaagtgcaagtatcccacggatggttcatcacctaaatccttgagatacattggcagcatggttgctgatgtccaccgcaccttgctatacggcggcatatttctgtaccccgcagacaagaagagcccgaacggaaagctccgtgtgatgtatgaggtgttccccatgtcattcctgatggaggaagctggaggccagtctttcacaggcaaaggacggtcgctcgatctgatccccaccgacatccacgagagatccccgatattcctcggcagcagcgacgacgtggaggagatcaaggcgctgtacgcggaggaagccaagaaggcaggatctgcatgaagatccacggtcatgtcgcgcaaggcgtgtaaatcgacgacgactcatgggccttgctggcaaatgtgattcatatatcaggcatttcttttctatacgtctgtgtcattcagtgtaatatactagcgtggaggcctcgaacagcttcatacatgagctgccagggtttctgcttctttccacaattcgttcactgatgatacgaaatatacatccatgtatacatatattcagctcaggaatggctgtgtgcatcgttgaggccgggggacagaaccagtgcctcgagctgtgcagaatgcattgcatatacatacaaattgctacatcatgtgattaaacatgttgactactcccttagttcctaaatataa

SEQ ID NO: 216 - DNA, 1728 bp, Hordeum vulgare
gatgggcacaggctgctcctcccttctttcccggacacgtctggccgcgctgccgagcatatccacgccgacgtggaagcccgcaccgcacctcatccggcacgcctcccaccggccaccggcttccgttccgccgcctatatcatcaatccccgggccgcgcatcggattccctctccccatctctaacaaccatccgcgggcggtgcaatctgtttgcatccgtccttcccacccctcagccgccctcgctcgctagcgcagttgctcggcggagaatcggcgtcggtccagagcagagcagagaagagaagatggaccacgcggcggaggcgcagcggacggacctgatgacgatcacgcggcacgcgctgaacgagcagggccggcacccggagtcccggggcgacttcaccatcctcctctcccacatcgtcctcggctgcaagttcgtcgcctccgccgtcaacaaggccggcctcgccaagctcatcggcctcgccggcgacaccaacatccagggggaggagcagaagaagctggatgtgctctccaacgaggtctttgtcaaggcgctcatcagcagcggccgcacctgccttctcgtgtctgaggagaacgaggcggccatattcgtggacgccccgctccgcgggaagtactgcgtatgcttcgaccccttggacggctcctccaacatcgactgcggcgtctccatcgggaccatctttgggatctacatgatcaaagacaaggacaacgcgactctggaggacgtgctgcagcccgggaccgacatgatcgctgctggctactgcatgtacgggagttcatgcacgcttgtgttaagcactgggaatggtgtgaatggcttcactcttgatccttcccttggggagttcatacttacccatcccaacataaagataccaagcaaggggaagatctattctgtcaacgaagggaatgccagaaactgggacgggccgacagcaaagtacgtagagagatgcaagttcccccaagacggctcatcgcccaaatccttgagatatattggaagcatggttgctgatgttcaccgtaccctgctctacggaggcatatttctgtaccccgcggacaagaagagccccaacggaaagcttcgtgttctgtacgaggttttccccatgtcattcctgatggagcaagccggaggccaatctttcaccggcaaacagcgggcccttgaaattgtcccttgtgacatacaccagaggtctccgatattcctcgggagctacgatgatgtggaggagattaaatcactgtacgcttcggagtcgagcaccgcctgatccgagcacatatacgcatgttctgcatcgcgttgctaaaaggaaaagttatgttcagcgttgtgacggaactccttgggtagctgctacgcatccatcgggtgatgtttagaaaacattcaccatcttgataaccgtaggattgtaagctcatcaaccgtccgatcttctttcaatgaactttgcaacaaggctcgtgttgcgttcggcgctttgcaacacgagtcatgttgtgctacggtcgaactgtttttttttttgaaacaatgcctatgtttcagaaacaaagactgtgttgcgaaaatatctatataattgtatttacaacagagttgtgttatagagtattttctgcaacaaagatcgcgttgcagaaatatctaccgtt

SEQ ID NO: 217 - DNA, 1287 bp, Phaseolus coccineus
ccgttgctgtctcagtgtgattaaagttgttaagtttattgaaaattgttggaattgaaaatggaccacagtgccgatgcacatcgcacggacttgatgaccataacgcgcttcgtgttgaacgagcaatccaaacaccctgagtcacgcggtgatttcaccatccttctcagtcacattgtgcttggttgcaagttcgtttgcaccgccgttaacaaggctggacttgcgaaacttattggactcgctggagagaccaatattcagggtgaagaacagaagaaactggatgttctttccaatgaggttttcattaaggctctcgtaagcagtggccgaacctgtatcttggtttctgaagaaaacgaagacgcgataattgtggagccttctaagcgtggaaagtactgtgttgtttttgaccccttggatggctcgtcaaacattgattgtggggtttccattggcacaatttttggaatttatacgttagcagatgtccatgaaccaactgtagaggatgtcctgcttcctgggaagaaaatggtggcagctggttattgtatgtatggaagctcttgcacgcttgtgttaagtactggagctggtgttaacggtttcacccttgacccatctcttggtgaattcatcctaactcaccctgacattaagatccctaacaaaggaaagatttattcagtaaatgaaggaaatgccaaaaactgggatggtcctactgcagcttacgttgaaaaatgcaagtttccagaagatggttcatcgccaaagtctctaagatatattggaagcatggtagctgatgttcatcgtacattgctttacggaggcatctttttgtaccctggtgataagaaaaatcctaacggaaaacttcgtgttctgtatgaagtcttcccaatgtcatttttgatggaacaggcaggaggacagtctttcacgggcaaggaacgggcacttgatttagttccaacgaagttgcacgagcgatctcccattttccttggtagctatgatgaagttgaggaaatcaaagcgctttatgctgctgagggtgaagaagaatgatcctgaaagacatgcatccttgtatttttggctactcacatgcacttgttttcccatttttattagcaggttcttattgaaaacttcttagctgctatgtatttatgctaataaaagtggttagcgtacctttcatggttataaaatttatgtatataaaaattatttagaataaagtagcaatttagcatggtcctgttt

SEQ ID NO: 218 - DNA, 1246 bp, Phaseolus coccineus
ctcatatgtacatgcagtgttgaagtcatcatcatcactttgagggttcgtgaagagtgaaagatggatcacagtgcggatgctcaacgcacagacttgatgaccatcacccgtttcgtgctgaacgaacagtccaagcaacctgaggctcgtggcgatttctcaatcttgctcagtcacattgttctcggctgcaagttcgtttgttctgctgttaacaaggcgggtcttgctaagcttattggacttgctggagagacaaatgtccagggtgaggagcaaaagaaactggacgtcctttccaatgatgtctttgtcaaggctctggtcagcagtggacgaacatgcatcttggtgtctgaagaagacgaggaagcaacatttgtggagccttctaagcgtggaaagtacattgttgtttttgatccgctggatggttcctctaacattgattgtggtgtttccattggcacaatttttgggatttatttggtgaaagaaaacggtgaaccaaccatagaagatgttttgcaacctgggaagaacatgttggctgctggttattgtatgtacggaagctcttgcacgtttgtgttaagcactggaactggtgttaatggtttcacccttgatccatctcttggagagttcattctaactcatcctgacatcaaggtcccgaagaaagggaagatctattcagtgaatgaaggaaatgctaaaaactgggatggtcctactaccaagtatgtggagaactgcaagtttccaaaagatggttcatcaccaaagtccctaagatatgttggaagcatggtagctgatgttcaccgcacatttctttatggaggtatctttctgtacccggctgataaaaagagtccaaatgggaaacttcgtgtactctatgaagtcttcccaatgtcattcttgatggagcaagcaggaggacaggctttcactggcaagcaaagggcacttgatttggttccaacaaaattgcacgagcgatctcccatatttcttggaagctatgaggatgtggaggaaatcaaggccctttatgctgctgatcagacactggaatgaatgaatgaaaaagcataattctttgtcttttccaacttacaatcaattctcatctaattgttgcacagatacatggtcatgtatatgttaagaaagcattgttaatgttttgtgatttacaaaaattagtttattacgccawatctaaatattttac

SEQ ID NO: 219 - DNA, 1292 bp, Beta vulgaris
ataaaaagagctccaatctttgaggagagagaaagtgcaaaagaagaagaagaacatggatcatgcagcggatgcaactcgtacagacttgatgaccataacacgtttcgtattgaatgaacagtcgaaacgtcctgagtctcgtggtgacttcaccattcttatgagtcacattgttcttggctgcaaatttgtctgctctgctgttaataaggctggtcttgccaagctcataggacttgcaggggagacaaatattcagggtgaagagcaaaagaagttggatgttctttcaaatgaagttttcattaaggccttgataagtagtggcagaacttgcattcttgtgtctgaggaggatgaggaggcaacattcgttgagccatctctacgtggaaagtattgtgttgtttttgaccctttggatggatgttccaacattgactgtggtgtatcgattggcactatctttgggatttacatggtgaaagatcttaataatgcaactcttgatgatgtcctccaacctggaaaaaatatggtagctgctggttattgcatgtatgggagctcttgcacgcttgtcatgagcactggaagcggtgtcaatggtttcactcatgacccatctcttggagagtttattttaactcatccggacatcaagatcccaaagaagggtaagatctattctgtgaatgaaggcaatgcaaagaactgggatggcccaacaacaaagtacgtggagaaatgtaagttccctaaggatggttcatcaccaaaatctctcagatacatcggaagtatggtagcggatgttcatcgcactctactttatggtggcatctttatgtaccctggtgataagaagagccctaacggaaaactacgagttctttatgaggtctttcccatgtcattcttaatggagcaagcaggtggacaagcttttactggcgaacaacgggcacttgacttggtcccaaagaacatacatgatcgttcaccagtattccttggcagctatgacgacgttgaagacatcaaagcactctatgctgctgaacagaagaatgcttgagcttcagcagatgttagatctacctgagttccctccaattggatccaaatttactttctacatataacagtggtcacaactgaactttgtgcccgtatatatgctccataaatgtgcataacataggaatatatacatttacgtgagcactggttaattgttaagtaactatatttcttcattaatgtcaatggtaaacctgttctaaacc

SEQ ID NO: 220 - DNA, 1287 bp, Brachypodium distachyon
cggcgccggcgagatggatcacgcggcggacgcgcaccggacggacctgatgaccatcacgcggcacgtgctgaacgagcagagcaagtacccggagtcccgcggcgacctcaccatcctcctctcccacatcgtcctcggctgcaagttcgtcgcctccgccgtcaacaaggccgggctcgccaagctcaccggcctggccggcgagaccaacgtccagggagaggagcagaagaagctggacgtgctgtccaacgaggtgttcgtcaatgcgctcgtcagcagcggccgcacctgtgttcttgtgtccgaggaggacgaggaggctacgttcgtggcccctgcgctccgtgggaagtactgtgtctgcttcgatcccctggatggctcctccaacatcgactgtggcgtctccatcggaaccatctttggaatttacatgatcaagaaccaagacaccgtgactctggaggaagtgctgcaacctgggaaggacatgattgctgctggatactgcatgtatggaagttcctgcacgcttgttcttagcactggaaatggtgtcaatggcttcacgcttgatccttctcttggagagttcatcatgactcatccagacatcaagatacctccaaaaggaaagatttattcggtgaatgaagggaatgcgaagaattgggacacacctactgcaaagtatgtggagaagtgcaagttccctacggatggttcatcacccaagtccttgagatacattggcagcatggttgctgatgtccaccgcaccttgctatacggaggtatatttctgtaccctgcagacaagaagagcccaaacggaaaactccgtgtcatgtatgaagtcttccccatgtcattcctgatggagcaagctggaggccagtctttcacaggcaaagaacgggctctcgatctgatcccaacaaagatccacgagagatcccccatatttctcggcagcagcgacgacgtggaggagatcaaggcgctgtacgcggaacaggcgaaagcaacctcggcatgatcggtcatccgaaaggcggtgtgaatcgacacaactccctggccttactgtaatgtgatcttcatcaggcgtttcttttaatcatgcggcattcagtatttcagtgtaatatagtgtggaggcctcgaacagcttcctgagcggctatggcctctgctcgtgttacaacgattaatcactgatatacggtcgtaatatttccgtcaaaaaaataatatacggacatacggtcgtaaaacatc

SEQ ID NO: 221 - DNA, 1057 bp, Brachypodium distachyon
cacgaggtagtagtagtaacgatcatggatcacgcggcggaggcgcagcggacggacctgatgacgatcacgcggcacgcgctgaacgagcaggggcggcacccggagtcccggggcgacttcaccatcctcctctcccacatcgtcctcggctgcaagttcgtcgcatccgccgtcaacaaggccggcctcgccaagctcatcggcctcgccggcgtcaccaacgtccagggagaggagcagaagaagctggatgtgctgtccaatgaagtctttgtcaaggcgctcgtcagcagcggccgcacttgtgttctcgtgtccgaagagaacgaggaggccatattcgtcgatgctcccctgcgtggaaagtattgcgtctgctttgatccgttggatggctcctccaacatcgactgcggcgtctccattggaacaatctttgggatctacatgatcaaagaaaaggacaacgccactttggaggatgtactgcaacctggaactgacatgattgctgctggctactgcatgtatgggagttcatgcacgcttgtcctaagcacgggaaatggtgtaaatggtttcactctcgatccttcccttggggagttcatactaactcatccgaacataaagataccaaagaaaggaaagatctattcggtcaatgaagggaatgcccaaaactgggatgcgcccacagcaaagtttgttgagaaatgcaagttcccccaagacggtacatcagcaaaatccttaagatacattggaagtatggttgctgatgtccaccgtaccctgctatatggaggcatatttctgtaccctgcggacaaaaagagcccgaacgggaaacttcgtattctgtatgaagtttttcccatgtcattcctgatggagcaagctggaggccaggctttcactggcaaacagcgggcccttgaactcgttcctacagagatccatcagaggtctccgatattcctcgggagctacgatgatgtggaggagatgaaatcattgtatgcttcagagtcaagcacggcctgatctgggt

SEQ ID NO: 222 - DNA, 1161 bp, Brassica napus
tgcagccccccccccccccgctcctgccttagaagcttcataacgaaacaaagatggatcacgaagcagatgctttccgtacggatttgatgaccatcacgagattcgtgctgaatgagcaatcaaagtatccagagtctcgtggggatttcacgattttgctcagcaacatcgttttgggatgcaaattcgtctgcagtgccgtcaacaaggctggtttggccaagcttattggacttgcaggggacacaaatatccagggtgaagagcaaaagaaactggatgtgctctctaacgatgtttttgtcaaagctttggttagcagcggcagaacttctgttcttgtctcggaagaagatgaggaagctacgtttgtggagtcatccaagcgtggaaagtactgtgttgtttttgatccacttgatggatcctcaaacattgactgtggtgtctccattggaacaatctttggaatttacacaatggaacacagtgatgagccgactactaaagatgttctgaaacctgggaatgaaatggttgcagcgggttactgtatgtacggaagctcctgcatgcttgtgttgagcacaggaacaggtgtccacggatttaccctggacccatctctaggagagttcatattaactcacccagacattaagattccaaagaagggaaacatatactcagtgaatgaaggaaatgctcagaactgggatggtccaaccacaaaatatgtagagagatgcaagtatcccaaagatggttctcccgcaaagtcactgagatatgtcggaagtatggtagccgatgttcatcgcactctgctttatggaggaatcttcctgtagccggctgacaagaaaagccccaatgggaaattgcgtgtcctgtatgaagtcttcccaatggcattcttgatggagcaagctggaggtcaggccttcactggcaagaaaagggcactggaccttgtcccgaaaaagatccatgagcgttctcccatatttcttggtagctatgacgatgtagaggagattaaggctctgtatgctgcggaggagaataactaagctttccattgtaatattttatttctatatatctcctggacaaaccaaatgaatcatgaataccaataagactggttaaaaaaaa

SEQ ID NO: 223 - DNA, 1263 bp, Brassica napus
gacaaaaaagaataaggcaatctctaaaacataaaaaggcatttggtggcgtagacgagagagagagagagaggatcaaagatggatcacgaagcagatgcataccgtacggatctgatgaccatcacgaggttcgtgctgaatgagcaatcaaagtacccagagtctcgtggggatttcaccattttgctaagcaacatcgttttgggatgcaagttcgtctgcagtgctgtcaacaaggctggtttggccaagcttattggacttgctggggaaacaaatatccagggtgaagagcaaaagaaactcgatgtgctctccaacgatgtctttgtcaaagctttggttagcagtggcagaacctctgttcttgtctcagaagaagatgaggaagctacgttagtggagtcatccaagcgtggaaagtactgtgttgtttttgatccacttgatggatcctcaaacatcgactgtggtgtctccattggaaccatctttgggatttacacaatgagccacaatgatgagccaactactgaagatgtcttgaaacctgggcatgaaatggttgcagcgggttactgtatgtacggaagctcctgcatgcttgtgttgagcactggaaccggtgtcaatggatttaccctggacccatctctaggagagttcatattaactcacccggacattaagattccgaaaaagggaaacatctattcagtgaatgaaggcaatgctcagaactgggatggtccaaccacaaagtatgtagagaaatgcaagtttcctaaagatggttctcccgctaagtctctgagatatgtgggaagtatggtagccgatgttcatcgcaccctgctttatggaggaatcttcttgtacccggctgacaagaaaagccccaatgggaaactgcgtgttctgtatgaagtcttcccgatgtcgttcttgatggagcaagccggaggacaggccttcactggcaagaaaagggcgctagaccttgtgccggagaagatccatgagcgttctcctatatttcttggtagctacgaagatgtagaggagattaaggctctgtatgctgcagacgaatagaagaaataagattctcactcttcttatttcatcactcttctctcttatatctatgtcttcttctgttgagacaaacaaatgactcatttatacaagagagactttttctcattttttcaatgcacctaagatatttttttttcattttctattctaatctgtctc

SEQ ID NO: 224 - DNA, 1394 bp, Manihot esculenta
ggtsgaatccagcaatttctcacctcagctgatcccttatatctcttattgatgctcttgtaatctcactcgtcaagcttaaatttttatggttttcttgtagtaaattttgtgggttgagcgagagagggagagagagatggatcacgcagcagatgcccaccggaccgatttgatgaccataacgaggtttgtattgaatgagcaatcaaagcacccggcttctcgtggggatttcactatcttgctcaatcatattgttcttggctgcaaattcgtttgctcagctgttaacaaggcgggtctcgccaagcttattggacttgctggggagacaaatgttcagggtgaagagcaaaagaaactggatgtgctttcaaatgaagtattcatcaaggctttagtaagcagtggacgaacatgcatwcttgtctctgaagaagatgatgaggcaatatttgtggagcctggcaagcgtggaaagtactgcgttgtgttcgatccattggatggatcctccaacattgactgtggtgtttctattggaacgatctttgggatttacatggtgaaacatggcaatgaaccaactctagatgatgttttgcaacctggatcaaatatggttgcagctggctattgcatgtatggaagctcttgcatgcttgtgttgagcactggaagtggtgttaacggttttacycttgatccatctcttggggagttcatacttacacatcctgatattaagattccaaagaaaggaaagatttattcagtaaatgaaggaaatgctaagaactgggatggtccaacrgccaaatatgtagaaagatgcaagttccctaaggatggttcctcaccgaagtctctaagatacgttggaagcatggtggctgatgtccatcgcacattactctatggggggatatttttgtaccctgcagacaagaagagtcccaatgggaagctgcgtgtgctgtatgaagtctttccaatgtcatttttgatggaacaagcaggaggtcaatcatttactggcaagcaacaggcacttcacttggttccagagaagatacaccagcgatctccaatatttctgggcagctatgatgatgttgaggaaatcaaagctctctatgctgctgaaaatgcagaagcttagagtgcagtaagaatcactcttatatgtggccttattaattgtaatgtggctacttgaccactcttctaatattatatttataggctaaaaatctctttctcaagtttctttcaataagatgatagtttatcagtgataactagtttttggttaatatattttaaataatgttaaaatcattttgttgaagtggtttgaatggaagttcatgtgcttcatgattctcaat

SEQ ID NO: 225 - DNA, 1192 bp, Ricinus communis
atggatcacgcagcagatgcacacaggactgatttgatgaccataacaaggtttgtattgaatgagcaatcaaagcatcctgattctcgtggagatttcaccatcttgcttagtcatattgttcttggctgcaagttcgtttgctctgctgttaacaaggctggtcttgctaagcttattggacttgctggggagacgaatgttcagggtgaagagcaaaagaagttggatgtgctttcaaatgaagttttcatcaaggctttagtaagcagtggccgaacatgcattcttgtctcagaagaagatgacaaggcaacatttgtggagcctgccatgcgcggaaagtactgtgttgttttcgatccattggatgggtcctctaacattgattgcggtgtttctattggaacgatctttgggatttacatggtgaaacatggcaatgaaccaacactagatgatgtcttgcaacctgggaagaatatggttgcagctggttattgcatgtatggaagctcttgcatgtttgtgttgagcactggaaatggtgttaatggtttcaccctcgatccatcccttggggagttcattcttactcatcctgatattaagattccaaagaaaggaaagatttattctgtaaatgaaggaaatgctaagaactgggatgatccaacagccaaatatgtggagaattgcaagttccccaaggatggctcttcaccaaagtctctaagatacgttggaagcatggtagccgatgtccaccgcacattcctttatggggggatatttttgtaccctgctgataagaagagtcccaacggaaaattgcgtgttctatatgaagtctttccaatgtcattcttggtggaacaagccggaggtcaggctttcactgggcagcaaagggcacttgatctaattccaacaaagatacacgagcgatctccaatatttcttggaagctatgatgatgttgaggaaatcaaagcactatatgctgcagaagcaaaaagggcgtaaaagaatcattcctcggtcacatatttacatagcctttaattattgtatgatggctacttgaccacattcctgagcatatattcatagaataaaactctctttcacaatttttttttttcaataggggatatgtttactggtgacaagaagtgagtgttggttgatt

SEQ ID NO: 226 - DNA, 1237 bp, Centaurea maculosa
attgcgtgattttgtcaccgatgaawtyaatcttgtactctgattgattatttttctttctttctttcacccaacccaacccaattatcaattgaagatcatcaaccatggatcataacgccgatgctttccgtacggatttgatgaccataactcggtttgtgctgaatgagcagtccaagcatcccgaatcacgcggtgatttcagcatcttgctcagccacattgttctcggttgcaagttcgtttgctccgctgttaataaggctggtttggcaaaactcattggacttgcaggggagaccaatgtgcagggagaagaacaaaagaaactggatgttctatcgaatgaagtttttgtcaaggctttggtcagcagtggaagaacatgcatacttgtctctgaagaggatgaagatgccataattgtggaaccgtcaaagcgtggaaagtattgtgttgtttttgatccgctggatggatcttccaacattgactgtggtgtttccattggaactatttttgggatttacatgataaaagatggcggtgagccatctttagaagatgtactgcagcctggaaagaatatgctggccgctggatactgcatgtatggcagttcttgcacgcttgtgttgagtgctggttctggtgtgaatggatttactcttgatccatctctaggggagtttatactcacccatcctgacattaagatcccaaaaaaaggaaagatttattcagttaatgaaggaaatgctaagaactgggatggtcccactgcaaagtatgtsgaaaaatgcaagtttcctacggatggttcgtctgcaaaatctctaagatatatcggaagtatggttgctgatgttcatcgcaccttactttacgggggcatctttttgtaccctgctgataagaagagcccgaacgggaaactgagggttctgtatgaagtcttccctatgtcattcttgatggaacaagccggaggccagtccttcaccggaaaggagcggtcrcttgatttggttccgaagaagatacatgaacgatctccaatcttccttgggagctacgatgatgtggaagaaatcaaggcattgtatgcagctgaagagaagaaggcataaacatcatcttgtgcagttgttacttgtcatttctctcttcataaaccatgccatgctatgctacttttccttcatatatttgtaataaaaagctacaatttckc

SEQ ID NO: 227 - DNA, 1275 bp, Cichorium intybus
ggcgggggattgagtgattttgtcaccgatgaaattcaatcttgtttgattttcaacacacattcaaaacctccataaccttgtcagagatcaactctatcgccggagaaacatggatcatgccgccgatgccttccggacggatttgatgaccataactcggtttgtgcttaatgagcaatcgaagcatccggagtcgcgtggtgatttcagtattttgctcagtcacattgttctaggttgcaagttcgtctgttccactgttaataaggcaggtttggcgaaactcatcggacttgccggagaaacaaatgttcagggagaagaacagaagaaattggatgttctctcgaatgaagtttttgtgaaggctttggtcagcagtgggaggacgtgcatacttgtttctgaagaagatgaagaagcaataatggtggaaccatccaagcgtggaaagtattgtgttgttttcgatccgctggatggatcttccaacattgactgtggtgtttccattggaactatttttgggatttacatgattaaagatggtgacgaggcacgtttagaagatgtattgcagcctggaaagaatatgctggctgctggatactgcatgtatggtagttcttgcacgcttgtgttaagcactggatctggtgtgaatggatttactcttgatccatctctgggggagtttatacttacccacccagacattaagatcccaaagaaaggcaagatttattcagttaatgaaggaaatgccaagaactgggatggtcccactgcaaaatttgtggaaaaatgcaagttccccacagacggttcatccgcaaaatcattaagatatattggaagtatggttgctgatgtccaccgaaccttactttacgggggtatatttttgtaccctgctgataagaagagcccgagcgggaaattaagggttctctatgaagtgttcccgatgtctttcttaatggaacaagctggcggacagtcatttaccggaaaggaacgggcacttgacttggtaccaaagaagatacatgaacggtctccgatattccttggaagctatgatgacgtggaagaaatcaaggcactttatgcagctgaagagaaggcaaattaaacttatttacatgttgttgttgttgttgatgtgcagttactttcctttaatatttgtaatgaaaaaagctacattttatttcatgtaacctgtcttaaatgataaagagtaaagtaatatattatgatttaccttcc

SEQ ID NO: 228 - DNA, 1499 bp, Citrus sinensis
gtcgaatcagatcgtttcatcgagtacaagctgacgaaacacgctatcttcacttttcagtgacgaccacccaacctttctctcactctccacccgccacgtgtccttccactcttccatttcctgccgataacacaatcctctacgcttacatatatatccgctctcaatctcacgcccttgaatcgagcgctttatctttgcatatctcttagaaaacgacagcgtttctcttttaacccgccgaagaagatggatcacgaagcggacgcgcaccgtacggacttgatgactattactcgttttgtgctgaacgagcagtcgaagcacccggagtcccgcggcgacttcagcatcttgcttagtcacattgttctcggctgcaagttcgtttgttctgctgttaacaaggcgggtcttgccaagctaattggacttgctggagaaaccaatgttcagggtgaagagcaaaagaaattagatgtcctctctaatgatgtctttgtcaaagctttgatcagcagtggccgaacatgcatccttgtctccgaagaagatgaagaggcaatatttgtggagccctctaagcgtggaaagtactgtgttgtttttgatccgttggatgggtcttctaacattgattgtggtgtttccattggaacgatatttgggatttatatgatgaaagatagccatgaaccgactctagatgatgtgttgcaacctggcaacaatatgttggctgctggctattgcatgtatggaagctcttgcacgcttgtattgagcactgggagtggtgtcaatgggtttacgcttgatccgtctcttggggagttcatactaactcacccagatattaagattccaaagaaaggaaagatttactcggtaaatgaaggaaatgctaagaactgggatggtccaacagccaagtatgtggaaaaatgcaagttccctaaagatggttcatcaccaaagtccttaagatacattggaagcatggtagctgatgtccaccgcacattactttatggaggtatctttatgtatcctcgtgataagaagagccccaatggcaaattgcgtgtgctctatgaagtcttcccaatgtcattcttgatggaacaagccggtggtcaatctttcactggcaagcaacgggcacttgacttggttccaaagaagattcatgaacgttctcccatatttttgggcagctatgatgatgtcgaagaaatcaaagcactctctatgctgcggaagagaagaaagaatgagcttgtcaattctatctttcatgatgcttacatatctctgtcagatcccatttctgatcaactttccataacatgttacaaaactttcattaaggttcctttatgtattggaaatgatacagttccagtccaagctatatattttgaataaaaatgaaggtgaatgtttcagtttttgtattattcatttattgatataaaaaagcctgctcctcagta

SEQ ID NO: 229 - DNA, 1431 bp, Coffea canephora
gtcagctgcgccttatttctcctagtccttcctccttgatttgagtaccaccagtgacttcgactgcttccagcctactatttcctaagataagaagagcaaattccatcgatcccatcaattcttgataatcttcatattggtatttgaatttgtaaggctgcaaaaaacaagaaatggatcattcggcggatgcatacaggactgatttgatgaccataaccaggtttgtattgaacgagcagtccaagcacgcagaatctcgcggggatttcactatcttgctcagtcacattgttctsggctgcaagttcgtttgttctgctgtcaacaaggcaggcytggccaagctgattgggcttgcaggtgagacaaatgtgcagggcgaagagcaaaagaagcttgacgtgctatcaaatgaagtttttgtcaaagctctggtcagcagcggtcgaacatgcattctcgtctctgaagaagatgaactggccattgttgtggagccatccargcgggggaagtattgtgttgtgtttgatcccttggatggatcctccaacatcgactgtggggtctcmattggaactatttttggtatttacatgattaaagatcatagtgaaccraaattagagacgcgttgcagcctgggaagaacatggtagctgcaggctactgcatgtacggtagctcttgcacgcttgtgttgagcactggaagtggtgttaatggatttactcttgatccatctcttggagagttcatactgactcatccagaaattaagattccaaagaaaggaaagatatactctgtaaatgagggaaatgcaaggaactgggatgctccgacagctaaatatgtggagaaatgcaagttcccaaaagatggttcatcagctaaatcattaagatacattgggagcatggtagccgatgttcaccggacattgctctatggaggtatctttttgtatccagctgataagaaaagtcctaacgggaaattgagagttctatatgaggtcttcccgatgtctttcttgatggaacaagctggaggacaagcatttactgggaaggaacgggcacttgacctatttccaaagaagattcatgaaagatcaccaatatttcttggtagttatgatgacgttgaagaggtcaaagcactttacgctgaagagcagaaagcatagatatgtgaaactcttttaccttgttgatttggtccatctggaggctttgactgctaatttcttggagcaaaacaaactgttcgtttagtttttctttcaagttgcaaaactactgtattgcggtaaactgtgtgtgtcaagattgtggttcatgtcagtgaccatcacaactgacgtagagatgcactatgcacatatgttgacataaagaagcatgtgtagatttctacctc

SEQ ID NO: 230 - DNA, 1475 bp, Gossypium hirsutum
cgaaaaaggcaaaacccaatctctaatttcycctttatagtggttttgttacagtcatagctctgttgggtcacttcctttttttttctttgcttttgttttgtgtttttggagggagaagagagatcatggatcatgcagcagatgctcataggactgatttgatgaccataacacgtttcgtgttgaacgagcaatccaaatatcccgagtctcgtggtgatttcaccatcttgctcaatcacatcgttcttggttgcaagtttgtttgctcttctgttaacaaggctggtcttgccaaactcattggacttactggggagatcaatattcagggtgaggagcaaaagaaactggatgtgctttcaaatgaagtttttatcaaggctttagtgagcagtggcagaacttgcatccttgtctcggaagaagatgaagatgcaattattgtggagccctcaaagcgtggaaggtactgtgtagttttcgatccactcgacggttcctccaacattgattgtggtgtttctattggaacaatttttgggatttacatggtgaaagatgaccatgaaccaacactagctgatgtgctgcaacctgggaagcaaatggtagccgctggctattgcatgtatggaagttcttgcacgcttgtgttgagcactgggaaaggagttaatggattcacccttgatccatctcttggagagttcatactaactcacccagacatcaggattccaaagaaagggaagatctattcagttaatgaaggaaatgccaagaattgggacggacctacggctaagtatgtcgaaaattgtaagttccctaaggatggttccccttcgaagtctctgagatatattggaagcatggtagcggatgtccatcgcacgttactctacggagggacctttatgtaccctgctgataagaagagccccagtggaaagctgcgtgttctctatgaagtctttccaatgtcctttttgatggaaaatgccggaggtcaagcgttcactggaaagcaacgggcacttgacttggttccaactaagatacatgataggtcaccaatatttcttggcagctatgatgatattgaagaaattaaagcactctatgctgctgaagggaaaaaggaatgagtgtacaattctcattcttctccactctatctttactggattcaggtttcaatcatcaaagtatttaatccatttcaaagcttattctgtaatgggatactatatttatattgaacaatagttaagtttccccaaaagatatgggatgagaataaaaagaagtatagttattttaactgttatgcttggaaatttttttttttaaccaaaaaaattacccaaagcctgggaaaaaaattattttacccaatttttcccttgaaaaaaaaggagggtgggttgtaaaaaaaaagggggagaaaatttttttttttttttttt

SEQ ID NO: 231 - DNA, 1285 bp, Gossypium hirsutum
ttgggtcactttttttctttcgttcatatttggctctytktttttgttttttggtttagagagatggatcatgcagcagatgctcataggactgatttgatgacaataacacgtttcgtgttgaacgagcaatccaagyatcctgagtctcgtggggatttcaccatcttgcttaatcacatcgttcttggttgcaagtttgtttgctctgctgttaacaaggctggtctwgccaaactcatcggactcgctggggagactaatgttcagggtgaagaacaaaagaaattggatgtgctttcaaatgaagtctttgtcaaggctttagtaagcagtggcagaacatgcatccttgtctcagaagaagatgaagaggcgacttttgtagatccctcaaagcgtgggaggtactgtgttgtttttgatcctctagatggttcctccaacattgactgtggagtttccattggaacaatttttgggatttacatgatgaaagataaccatgaaccaactctagatgatgtactgcaacctggtaagcaaatgctggcagctggctattgcatgtatggaagctcttgcacgcttgttttgagcaccggagaaggagttaacggattcacccttgatccatctcttggagagttcatactaactcacccaggtataaagattccaaagaaagggaagatctattcagttaatgaaggaaatgctaagaactgggatggtccaacggccaagtatgtggaaaagtgcaagtttcccaaggatggttcttcttcaaagtctctgagatacattggaagcatggtagctgatgtccatcgtacattactctacgggggtatctttttgtaccctgcagataagaagagccccagtggaaaactacgtgttctgtacgaggtctttccaatgtcgttcctgatggaacaagccggaggtcaggccttcaccggaaaacaacgggcacttgacttggtgccaacaaagatacatgagagatctccaatatttcttggcagctttgatgatgttgaagatatcaaagcactctatgctgctgaagggaaaaaggaataaatgtacaaattctcactctcactctcactctcactctcactcagatagcttcacttggcttcggttttaaatcgtgtttaaaagatatattgtatttgttacgggactattactgtttatccatggatatatttttaaatttttttgctcctgtcatgttaaatctgttctatatctttttgagtatcaacttggg

SEQ ID NO: 232 - DNA, 1335 bp, Vigna unguiculata
catatgcataagcatgtaatgtaagtatatcatcactttgtgggttagtgwwgagtgaaagatggatcacagtgcggatgctcaacgcacagacttgatgaccataacccgtttcgtgctgaacgaacagtcgaagcaacctgaggctcgcggcgatttcacaatcttgctcagtcacattgttcttggctgcaagttcgtttgttctgctgttaacaaggcgggtcttgctaagcttattggactagctggagagacaaatgtccagggcgaggagcagaagaaactggacgttctttccaatgatgtctttgtgaaggctctggtcagcagtggacgaacatgcatcttggtgtctgaagaagatgaggaagcaacatttgtggagccttctaagcgtggaaagtacatagttgttttcgatccgctggatggttcctctaacattgattgtggtgtttctattggcacaatttttgggatttatttggtgaaagaaaaccgcgaaccaaccatagaagacgttttgcaacccgggaagaacatgttggctgctggttattgtatgtatggaagctcttgcacgtttgtgttaagcaccggaagaggtgtgaatggtttcacccttgatccatctcttggagagttcattcttactcaccctgacatcaaggtcccgaagaaaggaaagatctattcagtgaatgaaggaaatgctaaaaactgggatggtcctactaccaagtatgtggaaaactgcaagtttccaaaagatggttcatcaccaaagtccttaagatatgttggaagcatggtagctgatgttcaccgcacatttctttatggaggtatctttctgtacccggctgataaaaaragtccaaatgggaaacttcgtgttctctacgaagtcttcccaatgtcattcttgatggagcaagcaggaggacaggctttcaccggcaaggaaagggcacttgatttggttccgacaaagttgcacgagagatctcccatattccttggtagctatgaggatgtggaggaaatcaaggccctttatgctgctgatcaaaaattggaatgaaagaaaccataattctttgtcttttccaacttacagtcaattctcatctaattgttgcacagatacattgccatgtatatatgtcaagaaggcttgttaatggtttgtgatttacaaaaggtattatattacgtgatatccaaatacattttaatttaataatttcaatatatagcaatattttaatttttgtagatagttttctgatgatttcttgattattataatgttaaaattgcattttgtct

SEQ ID NO: 233 - DNA, 1267 bp, Cynara scolymus
ggggattcgtgattttgtcaccgatgaaattmatcttgtctgatattcyccaatttcaaaatcccgtagcgtcgtcggakataaactgtgtcgccggagaacgatggatcatgccgccgatgctttccggacggatttgatgaccataacacggtttgtgctgaatgagcagtcgaagcatccggagtcacgtggtgatttcagcatcttgcttagtcacattgttcttggttgcaagttcgtttgcgccgctgttaataaggcaggtttggcaaaactcattggacttgctggggagaccaatgtgcagggagaagaacagaagaaattggatgttctgtcaaatgaagtttttgtcaaggctttggtcagcagtggaagaacatgcatacttgtttctgaagaggatgaagatgccataattgtggaaccgtcaaagcgtggaaagtattgtgttgtttttgatcctctagatggatcttccaacattgactgcggtgtatccattggaactatttttgggatttacatgataaaagatggtggtgagccatctttagaagatgtactgcagcctggaaagaatatgctggctgctggatactgcatgtatggtagttcttgcacgcttgtgttgagcactggttctggtgtgaatggattcactcttgatccatctttaggtgagtttatactcacccatccagacattaagattccaaagaaaggaaagatttattcagttaatgaaggaaatgctaagaactgggatggtcccactgcaaagtatgtggaaaaatgcaagtttcccactgatggttcatctgcaaaatctttaagatatattggaagtatggttgctgatgttcatcgcaccttactttacggtggcgtctttttgtaccctgctgatwagaagagcccagatgggaaactaagggtctctatgaagcytccctatgtcgttcttgatggaacagctggagtcagtcattactggaaaggagcggtcacttgatttggttccgaagaagatacatgaacgatctccgatcttccttggaagctatgacgacgtggaagaaatcaaggcattgtatgcagctgaaggaaaggtataaaaaaggaaaggtataaaaagagagttaagcaagggaaattagcctcatctccatgttgttgtgcagttgctatttgtgatttctatgttcttaaaccatgccatactactctccatatttggtataaaaagctacattttgtgacc

SEQ ID NO: 234 - DNA, 1177 bp, Taraxacum officinale
actcaatcaccagacaaagatggatcatgaagcggatgccttccggacggatttgatgaccataactcggtttgtgctgaatgaacagtcgaagcatccsgagtcacgaggsgatttcagtatcctgctcagtaacattgttctaggttgcaagttcgtctgctccgctgttaacaaggcaggtttggcaaaactcattggacttgcaggggagacgaatgtgcagggagaagaacagaagaaattggacgttctctcaaatgaagttttcgtaaaagctttggtcagcagtggtagaacaagcatacttgtttctgaggaagatgaagaagcaatatttgtggaaaaatccaagcgtggaaagtattgcgttgtttttgatcccctggatggatcctccaacattgactgtggtgtttccataggaacgatatttgggatttacatgataaaagatggtaatgatgcatgtatagaagatgtattgcagcctggaaaggagatgctggctgctggatactgcatgtatggtagctcttgcacgcttgtattaagcactggatctggtgtgaatggattcactcttgatccatctcttggggagtttattctcacccaccccgacattaagatcccaaagaaaggaaagatttattcagtcaacgaaggaaatgctaagaactgggatggtccaactgcaaaatatgtggaaagatgcaagtacccaacagatggttcacctgctaaatccttaagatatatcggaagtatggttgctgatgttcatcgaaccttactttatggtggtatctttttgtaccctgctgataagaagagccctgatgggaaattaagagttctctatgaagtgttcccgatgtctttcttgatggaacaagctggcggacagtcatttaccggaaaggaacggtcacttgacttggtaccaaagaagatacatgaaaggtctccgatattcctgggaagctatgatgacgtggaagaaattaaggcactttatgcggctgaaggaaagggaaattaaacttatttgatctccatgttcttgtgttgccatttctttgttcataaaatcatgtacttttccttgcatttgtaataaataaaaaagcgacactttatgtaattgttctaaatattaggagtaatgttacat

SEQ ID NO: 235 - DNA, 1343 bp, Eucalyptus gunnii
cgksatcgttacatctctcctcgaataaagcgcattctgagctcggccttgccttgctcgaggggttcttatatacagagaatacgcgtcccagtgatttcacagagagagagagagagagagagagagagagagatggaccacgcaggcgatgcgtaccggaccgatttgatgaccataacccggttcgtgctcaacgagcagtcccggcacccggagtcccgcggcgatttcaccatcctcctcagtcacattgttctcggatgcaagttcgtctgctcttgcgttaacaaggcaggccttgccaaattgatcgggcttgctggagagaccaatgtccagggtgaagagcagaagaagctggatgtgctttcgaatgaagtatttgtaaaggcattagtcagcagtggccgcacaagcattcttgtgtcagaggaggatgaagaggccacgtttgtggagtcagctaagcgtggaaagtattgtgttgtttttgatccgctggatggatcctctaacatcgactgtggtgtttccattggaaccatctttgggatctatatgatcaagcatgccaatgatccaactttagaggatgtgttgcaacctgggaaaaacatgctggcagctggctattgcatgtatggcagctcttgcacgcttgtgctaagcactggatgtggtgttaatggttttaccctggacccatcattgggcgaattcatcctcacccatccagacatcaagattccaaagaaagggaagatctactcagtgaatgagggaaatgctaaaaactgggatggtccaactgctaagtatgttgagaaatgcaagttcccaaaagatgggtcatcctcaaaatctttaagatatattggaagcatggtagctgatgttcatcgtaccttactatatggaggtgtctttttgtaccctgctgataagaagagtcccagtggaaaactgcgcgttctttacgaagtcttcccgatgtcattcttgatggaacaagcaggaggtcaggcctttactggaaagcaacgggcacttgatttgatcccaaccaagatacatgagcggtctcccatattcctcggcagctacgacgacgtggaggaaatcaaggcactctacgctgctgaagaggacaaaaaataaagctgtagtttgctcttttcttgtgttcgcatcagacaagaccttgtccaactaccaggcttgattgatcgtgggttcacaagattagaaccctctatattgtttacttttaaccagatattggaataaatactttgtcagcaacctttgatagatagaaagtctaaattacagtgattttc

SEQ ID NO: 236 - DNA, 1116 bp, Festuca arundinacea
ggcacgaggccgagctaagcgagagagtgcaggcgaggagaggatcgtcgatcgaccgccggggaagatggatcacgcggcggacacgtaccggacggacctcatgaccatcacgcggtacgtgctcaacgagcagagcaggttcccggagtcgcgcggcgacctcaccatcctcctctcccacatcgtcctcggctgcaagttcgtcgcctccgccgtcaacaaggcagggctcgccaagctcaccggactcgccggcgagaccaacgtccagggggaggagcagaagaagctggacatcctgtccaaygaggtgttcgtcaatgccctcgtcagcagcggtcgcacmtgtgttcttgtgtccgaggaggacgagctggycacgttcgtggaccctaagctccgkggaaagtactgtgtctgcttygatcccctggatggctcctccaacatcgactgcggcgtctccatcggaacgatctttgggatttacatgatcaagaactttgacaccgtgacccttgaggaggtgctgctgcctgggaaggacatgattgctgctggatactgcatgtatggaagttcatgcacgcttgttctgagcactgggagtggtgtcaacggcttcacgcttgacccttctcttggggagttcatcatgacgcacccdgaaatcaagatacctcctaaaggaaagatctactctgtgaatgaagggaacgccaagaactgggacacgcctactgcaaagtacgttgagaagtgcaagtaccccacggatggttcatcacctaaatccttgagatacattggcagcatggttgctgatgtccaccgcacsttgctatacggtggtatattcttgtaccctgccgacaagaagagcccaaatggcaagctccgtgtgatgtatgaagtgtttcccatgtcgttcctgatggagcaagctggaggccagtctttcacaggcaaaggacggtcacttgatctgatccctaccaatatccacgagagatccccgatattcctcggcagctacgacgacgtggaggagatcaaggcgctgtacgcggaagaagcgaaggcaggatcggcatgaccgacgatcgtcgtatg

SEQ ID NO: 237 - DNA, 1826 bp, Zingiber officinale
gacacgcttccaactgtttgaacgtatctgccaataaggggagacagagggggagacagaggagagagagagaccggaagcggccaccggaggggcgttatctgcacctcaaccgccgaatccctatccttctctccgcctcttcttcatctttttcttcttcctcttcttccaatcgactctcgctctatatatgtacaagcgtatgcatctctaaaggtgaggcttgtgagatcgatctcagtcgctcgctgccgagaaagagggttagcgtcatggatcacgaggcggatgcgcaccggaccgacctcatgaccatcaccaggtacgtgctcaacgagcagtcgcggtacccggaatcgcgtggcgacttcagcatcctcctttcgcacatcgtcctcggctgcaagttcgtctgcaccgccgtcaacaaggccgggcttgctaagctcataggacttgctggggagacgaatgtacagggcgaagagcagaagaagcttgacgtgctttccaacgaagtctttgtcaaagctttgataagcagtgggagaacttgcattctagtttcggaagaggatgaagaggctacttttgtggatccatctctgcgtggaaaatactgtgtggtctttgatccactggatggttcctcaaacatcgactgtggtgtctccattggaacaatttttggcatttacatggttaaagacaaggagaatgtgactttaaatgacgtattacaacctgggaagaatatgctagcagctgggtattgcatgtacggcagttcttgcatgcttgtattgagcactggaagtggcgtgaatggtttcacgcttgatccttctcttggggagttcatacttacacatccatatattaagataccaaagaaaggcaaaatatattcagtgaatgaaggcaatgccaagaattgggatcgacctacaacaaagtatgtggaaaaatgcaaattccccgatgatggttcctcaccaaaatctctgagatacgttggaagcatggtggctgatgtacatcgaaccctgctttatggaggcatctttttatacccttctgacaagaagagtcctgatgggaaattacgtgttttatatgaagtcttccccatgtcattcttgatggaacaagcaggtggtcaatctttcactggaaagcaacgggctcttgacttagttcctacaaaaattcacgagaggtcacccatatttctaggcagctacgatgatgttgaggagattaaagcgctgtatgctgctgaagaaaacaacgattgatgcttctgttagtcttgtaaagttgtaatttactatcctaataaatactgtcatcatcaagcatgaatcaatctcaggcctatattctcacttcattacaacaattaaatccattgatattctgttagtttgtttttttggtttggaactaccaacaagcgactgatcagatctacatatattaaatagaaatgctatttagatgctgcttatatatctgttaatttgtatatactgctgtattttttaaaaaataaaatcatgtgtaacttgtgattaagacattttaatcatgcaaactattagcataaaaaagatctgactgaacaaaacagatgacaatattacaacaacattacttgcgacaacaatagaacaagagagttcaaaacttcttcccatcgtttaccatctccagccaaattaactattcaaaacaagatcttaaaaaaaattcgatttttgtagcactggcaagacaccatgttcgatccctcgtgccgaattcggcacgaggcckcgtgc

SEQ ID NO: 238 - DNA, 1508 bp, Vitis vinifera
ctcgtaaccgccgaataaggaggaggaagacgacgcaacgcgttatctctgctcagcaccactcgaagcgctttcagcggccgagccaccacgtgtcgtccgaaacttctatttctatctgataacctcatctctcatcccctgccacatttatacaatccctttcctttctcgttataatacgttttcagtcctcgaggggagggcaaactgatactctggagcgctgcttgcttgctttttcaaaaccctaaccgctgtctttgcctggggaattcgggacgatggatcacgaggctgattctcaccgcaccgatttgatgaccataacgcgttatgtgctgaacgagcagtccaggcatcccgagtcgcgcggtgacttcaccatcttgctcagtcacattgtgctcggctgcaagttcgtctgcactgccgttaataaggcgggtcttgccaaactgattggacttgctggagagaccaatgttcagggtgaagagcaaaagaaactggatgtgctttcgaatgaagtttttatcaaggctttagtaagcagtggccgaacatgcatccttgtatctgaagaggatgaagaagcaacaattgtggagccatctaagcgtggaaggtattgtgttgttttcgatcccttggatggatcctctaacattgactgtggtgtttccattggaactatctttgggatttatatggtgaaagatggtggtgagccaactcttgataatgtgttgcaacctggaaagaatatgttggcagctggttattgcatgtatggaagctcttgcacgcttgtgttaagcactggaactggtgttaatggatttacccttgatccatcacttggggagttcatacttactcacccaaacattaagattccaaagaaaggaaaaatttactcagtaaatgaaggaaacacaaagaattgggatgctccaacagccaagtatgtggaaaaatgcaagttccccaaagatggttcatcaccaaaatctctacgatacattggaagcatggtagctgatgtccaccgcacattactttacggtggtatctttttgtaccctgctgataagaagagccccaacggaaaactgcgtgttctctatgaagtctttccaatgtcattcttgatggaacaagcaggaggtcaagcttttactggaaagcaacgggcacttgacttagttccaaagaatatccacgaacggtctccaatattccttggcagctacgatgatgttgaagaaattaaagcactctatgctgctgaagagaagtaaggataggttcataaatctcatttctcttgtactatccttatctccttaactgctgttcaggtgctatacccgatatctgatttcatctattcataagatagtacttctcctaaagctcctttgtaataagatacaatttcttgatgaaaaaacatccattgtgttcaccttgaataacagtgaaatcagcttctttcttaaaaa

SEQ ID NO: 239 - DNA, 1240 bp, Mesembryanthemum crystallinum
gctctactcaaaaaaaatctagagagagaaagttaactctagagagagaaaatcagagaagatggatcatgaggcggatgcataccggactgatctcatgaccatcacccgtcacgtgcttaacgagcaatccaagcatcccgagtcacgtggcgacttcaccatcctcctcagcaacattgttctcggctgcaaattcgtctgctccgccgtcaataaggctggtcttgctaagctgataggacttgcaggagagactaatatccagggtgaagagcaaaagaaactagatgttctttcaaatgacgtttttgtcaaagccctcataagtagtgggcgaacttgcatccttgtgtctgaggaggatgaggaggcaacatttgtcgagccttctaagcgtggaaaatattgtgttgtttttgaccctctggatggatcatccaacatagactgtggtgtttctattggaactatatttgggatttacatgatcaaaaattatgataatccaactcttgacgatgttctgaaatctggaaggaatatgttagctgctgggtactgcatgtatgggagctcttgcacgcttgtcctgagctctggaaatggggtcaatggcttcactcttgacccatctcttggagagttcattcttactcatccagatatcaagataccaaagaagggaaaaatctattcggtaaatgaaggcaatgctaagaactgggatggcccaacagcaaagtatgtggaacgatgcaagttcccaaaagatggctcatcaccaaagtctctcagatacattggaagcatggttgctgatgtccatcgtacattactttatggaggcatctttatgtaccctgctgataagaagagccctaatgggaagttacgagttctctatgaggtcttcccaatgtcatttttgatcgaacaagctggaggacaagctttcaccggcaaacaacaggcactggacttgatcccgacgcagatacatgagaggtcaccagtattccttggcagctatgatgatgttgaggaaatcaaagccctttatgctgctgaagagaagagtgcataagtttgttgggatctcaaatccttattctaacaatcctgctacaagatatagggtattacttgttcactgattcgtacagtgattcaatacaaacttgtgtccatatctatgcctcatcaatgtgcagcgcatttgactgtttgcatttggcag

SEQ ID NO: 240 - DNA, 1189 bp, Ipomoea nil
tggagcaagggtttagaggaatcgggagagatggatcacgcggcggacgctcaccggacggacctgatgaccataacgaggtttgtgctgaacgagcagacgaagcacccggagtctcgtggcgacttcaccatcctcctcagccacattgtccttggctgcaaattcgtctgcactgccgtcaacaaggctggtttggcgaaactcatagggcttgctggtgagaccaatgtacagggtgaagaacaaaagaaactggatgtactctcaaatgaagtttttatcaaagccttggttagcagtggtcgaacatccattctagtctctgaggaagatgacgaggcaacctttgtgaagccaccattgcggggaaaatattgtgttgttttcgacccattggatggatcttccaacattgattgtggtgtttctattggaactatttttgggatttacatgatcaaagataatcatgaaccagaattaagtgatgttttgcaacctgggaagaatatgttagctgctggctactgcatgtatgggagctcctgcacgtttgtgttgagcactggatctggagttaatggctttacccttgatccatcactaggggaattcatactaactcatccagatatcaagatcccaaagaaaggaaagatctattctgtgaatgaaggaaatgctaaaaactgggatggtccaacagctaaatttgttgaaaactgcaagttccctaaagatggttcatcaccaaagtctctaagatacatcggaagcatggttgcggatgttcatcgcacattactttatggtggcatcttcttgtaccctgctgataagaaaagtcccaatgggaagctgcgggttctatatgaagtgtttccaatgtcattcttaatggagcaggctggaggccaagcatttactggcaaactgcgggcccttgacttggttccagagaagatccatgagcgttctcccatatttctgggcagttatgatgatgttgaggccattaaagcactttatgctgctgaagactaaacggaactgaaacctccgatccctctgcaatctccacataccaggcccaagctttatgatactgcgtaattgcaatttcaagtatataatttgtgcttataaaccttattatcttcagcaattacacacttattgcagctag

SEQ ID NO: 241 - DNA, 1405 bp, Lactuca sativa
gaagaagaagcaaccaccagccctctttacagttatcctcctgacaaccgctagcgtcaccgtcacgccgttctccgccacgtgtcatctgaacttccactggcctcagataacctcatcttcgattcctgtgcacatataagaacgctattatcttccagcctctccttgaattgcgtgattttgtcaaccgatgaaattcaatcttgtctgatttcgatacagattgaagcaaacaacaatttagagttgttagagatcaactctatcgccggagaaagatggatcatgccgctgatgccttccggaccgatttgatgaccataactcggtttgtgctgaatgaacagtcgaagcatccggaatcacgcggtgatttcagtatcctgctcagtcacattgttctaggttgcaagttcgtctgctccgccgttaacaaggcaggtttggcaaaactcattggacttgctggggagacgaatgtacagggagaagagcagaagaaattggatgttctgtcgaatgaggtttttgtgaaagctttggtcagcagtggtagaacttgcatacttgtttctgaagaagatgaagatgcaataattgtggaaccatctaaacgtggaaggtattgtgttgttttcgatcccctggatggatcttccaacattgactgtggtgtttccataggaactatttttgggatttacatgataaaagatggtgatgaggcaactttagaagatgtattgcagcctggaaagaatatggtggctgctggatactgcatgtatggtagctcttgcacgcttgtgttaagcactggatcaggtgtcaatggatttactcttgatccatctctaggggagtttatactcacccatgcagacattaagatcccaaagaaaggaaagatttattcagtcaatgaaggaaatgcaaagaactgggatggtcccactgcgaaatttgtggaaaaatgcaagtaccccacagatggttcatccgcaaaatccttaagatatatcggaagtatggttgctgatgttcatcggaccttactttatgggggtgtctttttgtaccctgctgataagaagagccctaatgggaaattaagggttctctatgaagtgttcccgatgtcgttcttgatggaacaagctggtgggcagtcatttaccggaaaggagcgggcgcttgacttggtaccaaagaagatacatgaaaggtctccgatattcttgggaagctatgatgacgtggaagaaatcaaggcattgtatgcagctgaagaaaaggcaaattaaactrattaattatcttatccatgttgttcttttgtttataaaatcatgctacttttcttcttatttgtaataataatwaaaaaagctactttttatgc

SEQ ID NO: 242 - DNA, 1704 bp, Leymus cinereus x Leymus triticoides
gtgccttccgcccgccgtgggagagagagataggagagatggaggagcacagcggcggtgctggccgatcccgtgtgttccacttgttcccgatccattctcctcgtctggtgccatcgcaatcgtcccgctgcctccccttcctctctacctcccctcctccaatcactctccccgaacagcggggctgaagtctgcggcaccggatgggtggaacgcagtggagacatagatgaggcaggaaccatcgcagctcccaggggagcagtggcgtcggaggcgagatttctccctcgagccgccggaggcggtgggatgggaaccagggagaggtagaggagggtggtctgtgctacaagcaacacgaactctccgtccgagctaagcgaacggagagrgagrgagggtcgtccccgghcggtcggagaagamgagatggatcacgcggcggacactttccggacggacctgatgaccatcacgcggcacgtgctgaacgagcagagcaagcacccggagtcgcgcggcgacctcaccatcctcctctcccacatcgtcctcggctgcaagttcgtcgcctccgccgtcaacaaggccggcctcgccaagctcatcggcctcgchggcgagaccaacgtccagggggaggagcagaagaagctggacgtgctctccaacgaggtgttcgtcaatgccctcgtcagcagcggtcgcacctgtgttcttgtgtccgaggaggacgaggaggctacgttcgtsgacccaaagctccgtggaaagtactgtgtctgctttgatcccctggatggctcctccaacatcgactgcggcgtctccatyggaacgatctttgggatctacatgatcaagaaccaagacaccgtgactctggaggaagtactgcagcctgggaaggacatgattgctgctggatactgcatgtatgggagttcytgcacgcttgtcctgagcactggaaatggtgtcaacggcttcacgcttgacccttctctcggggagttcataatgactcatccagatatcaagataccgccgaaaggaaagatctattcggttaatgaagggaacgccaagaactgggacacgcctactgcaaagtacgtggagaagtgcaagtatcccacggatggttcatcacctaaatccctgagatacatcggcagcatggttgccgatgtccaccgcaccttgctatacggcggcatatttctgtaccccgcggacaagaagagcccaaacggaaagctccgtgtgatgtatgaagtgttccccatgtcattcctgatggaggaagctggaggccagtctttcacaggcaaaggacggtcgctcgacctgatccccaccaacatccacgagagatccccgatattcctcggtagcagcgacgacgtggaggagatcaaggcgctgtacgcggaggaagccaagaaggcaggatctgcatgatgatcgacagtcatcgcrcgcaaggcgatgtaaatcgatgacgactcctgggcctcaccgcaatgtgattcatataccaggcatttcttttctatacgtctgtggcactcagtgtaatatagcgtggaggcctcgaacagcttcatacatgagcagccaaggcttctgcttctttccacaattcgttcactgatgatacgtaatatacatccatgtatacatatattcagctca

SEQ ID NO: 243 - DNA, 1330 bp, Eragrostis curvula
gcacgaggcaccctgccgtcgttgcactaagccaaagcgagtgaggagaggcgccggcggcggagcggggcgagatggaccacgcggcggaggcgcaccagacggacctgatgaccctcacgcggcacgtgctgaacgagcagagccggaaccccgagtcccgcggcgacttcaccatcctcatctcccacatcgtcctcggctgcaagttcgtcgcctcggccgtcaacaaggccggactcgcgaagctcatcggacttgccggcgagaccaacatccagggagaggagcagaagaagctggacgtcctgtccaacgagktgttcwtymaggcyctcgtcagcagcggkcgcacctgcattcttgtgtccgaggaggacgargaagcyacsttcgtggacccygcgctacgaggaaartactgtgtttgctttgacccccttgatggctcctccaacatcgactgcggtgtctccatcggaaccatmtttgggatttacatggtcaaggacaaggacaatgtgactctgaatgacgtgttgcagcctgggaaaaacatgcttgctgctggctactgcatgtatggcagttcctgcacgcttgttcttagcactgggaacggtgtcaatggcttcacacttgatccgtctcttggggagttcatactgactcatccaaacatcaagatacctaagaagggaaagatatattctgttaatgaagggaatgccaaaaattgggacgagcctacggcgaagtttgtggagaagtgcaaataccccaaggatggttcgccacctagatctttgagatacattggaagtatggttgctgatattcaccgtaccttgttatatggaggtgtatttttgtaccctgcagaccagaagagcccaaatgggaagctccgtgtyctatatgaggttttccccatgtcattccttatggaggaagctggaggccagtctttcaccggaaaagaacgggctcttgacctcgtccccaccaagattcacgagagatctccgattgtcctgggcagctacgacgacgtggaggagatcaaagcattgtacgccgaacaggcaaagtcgagctcgggctgatcagagcatcataagaggtgtaaatcgacttgttcccggccttgttgcgacatgaatcagacatttgtttcgttggtcttattgtaaaattgtaacatcaagtgtatggaggcctggaactgcttcacaagcaacaaaaggcttctatttcttacaaccgttcactacatacaaaagtacatgtcttgcagctaagacaaatttacgctccctggcaaaatcta

SEQ ID NO: 244 - DNA, 1493 bp, Zea mays
ccacgtcccaacaacttgccaattcgcaccgcgggaccggcgccgtcttgttgctccgctccggccgtgacacgagcgcacccgccaccaccgccagcccctcctcccccgtcgactcgagccacaggacaaggcatcccaaccgccgcccatctcctatcgtcatctgccgatccctcctcggttcctcacagtcacagagcctcacgtcacgtgtacctcccccaacccaacccagcccaacccagcccaaaacctagcgggcgaggggccggggaaccgaccgccggacgcggagatggaccacgcggcggaggcgcagcggacggacctgatgacgatcacgcggcacgtgctcaacgagcagagccgccacccggagtcccgcggcgacttcaccatcctcctctcccacatcgtcctcggctgcaagttcgtcgccgccgcggtcaacaaggccggcctcgccaagctcatcggcctcgccggagagaccaacgtccagggcgaggagcaaaagaagctggatgtcctgtccaacgaggtcttcgtgaaggcgctcgtcagcagcggccgcacctgtgtcctcgtgtctgaagagaacgaggaggccatcttcgtcgacccggccctccgcgggaagtactgcgtctgcttcgacccgctggatggctcctccaacatcgactgtggtgtctcaatcggaacgatctttgggatttacatggtcaaagacaaggacaacgtgaccttggaggatgtgctgcagcctggaacaaacatgcttgctgctggctactgcatgtacgggagttcctgcacgcttgtgctgagcactgggaacggagtcaatggcttcactctcgatccttcccttggagagttcattttgactcatccaaatatcaagataccaaggaaagggaagatctattcagtcaacgaagggaacgccaaaaactgggatgggcctacagccaaattcgtggagaaatgcaagtatcctgaggatggttcaccgcctagatccttgagatatatcggaagtatggttgctgatgtccatcgcaccttactatacgggggcatatttttgtacccagcagaccagaagagtccaaacgggaaactacgcgttctgtatgaagtcttcccgatgtcattcctgatggaacaagctggaggccaggctttcacaggcaaacaacgggcccttgaacttgctcccgctaaacttcacgacagatccccagtgttcctcgggagctacgatgacgttgaggagatcaaagcactgtacgcttcgatgtcaaacagcggttgacctttctgcctgaggaaacgagcgagatcaaaagcaccgtacgcttcagagtcaactgcttgatctttatagattgtaataaaataataaaagagtttgtaaaaaaaacaacaacactgcttgatctttctgcatgaggataaaaagcgcatagtttccccggttggat

SEQ ID NO: 245 - DNA, 1867 bp, Zea mays
cccttaccttcctacgccctgccgcgcgctacgtacgccaccggaccaccaccacaagcgctggacgcgagcggcccagcctgacgcagcgcggatagagggataggcctcgacgccgattccgttggagctccgcgacccttggctcccagcctcactttctcgctcgccgtgctaccctaccccgcagagacacgtcccgtcccgtcccgtcccaccctgtgccagccagctcccgaccggcgcccgccccgcgggatcttgtctaataatataccgtgcgcgcgggagcagcagctggttcgtcgtgcccgcgcgctcactgcactccgtgatcaccaccacaccgctatcctgctagctaggtagctgaattcggagccaggctcgagcgaggggagggcggaggcgagatggaccacgcggcggacgcgcaccggacggacctgatgaccatcacgcggcacgtgctgaacgagcagagccggaaccccgagtcccgcggcgacttcaccatcctgctctcccacatcgtcctcggctgcaagttcgtcgcctccgccgtcaacaaggccgggctcgcccagctcatcgggctcgccggcgagaccaacgtgcagggagaggagcagaagaagctggacgtcctgtccaacgaggtgttcgtcaaggccctcgtcagcagcggtcgcacctgcgtccttgtgtccgaggaggacgaggaagcaacgttcgtggaccctaagctgcgtggaaggtactgcgtctgctttgatcccctcgacggctcctccaacatcgactgtggcgtctccatcggaacgatctttgggatttacatcatcaaggacaaggacaacgtcactctggaggacgtgctgcaacctggcaagaacatgctcgccgccggatactgcatgtacggcagttcctgcacgctcgttctgagcactggaactggtgtcaatggcttcacgctcgacccttcacttggggagttcatactaacccatccagacatcaagatacctaagaaggggaagatctattcagtcaacgaagggaacgccaagaactgggacgcgcctgttgccaagtttgtggagaagtgcaagtaccccaaagatggctcgccaccaagatctttgagatacattggaagtatggttgctgacgtgcaccgtaccttgctatacggcggtgtgtttttgtaccctgctgacgagaagaacccaaacggaaagctccgtatcctgtacgaagttttccccatgtcgttcctaatggagcaggcaggaggccagtccttcacaggcaaagaacgggctcttgatctgatcccaaccaagatccacgacaggtccccgatattcctcggaagctacgacgacgtggaggagatcaaagcgttgtacgccgagcaggcgaagtcgagctcggcttcatcctaagtgagggtgtaaatcgacttttcctggcttaatttgttgcttacctgattcagacattcgtttccgtttcccttggtgtcgtcgtaagtgtgacattcagtgcaatatgtatagcaactaagggactccgtaaaagttacatgcatctctagcacctaaagcattgcgttataaccaacctaaaaagaggtgatcaggtgtcatagatgatgaaactactgtcgcaggctctgcaaaaatgtattgcgcatagagatccctgcaaaaaaaaatatggccgtgtcataaattgttcgatacttggaagaccaaagtcgaccctgtgtgatgtaaggcctgaaaacgctcgagttggacactgacatggagtgctggattatggcatcagggcgaactgtctgttgtctttcgatggc

SEQ ID NO: 246 - DNA, 1273 bp, Medicago truncatula
ggcacgaggaaatatttctttgaattaatttgtacactttgttcataatctcaaaaaaaatatggatcaccaagcagatgctaacagaactgatttgatgacaataacaaggtttgttctgaatgagcaatcaaagtatgctgaatcacgtggggatttcaccattctcatcaatcacattgttcttggctgcaaatttgtttgttcttctgttaacaaggctggattggcaaaaatcctaggacttgctggagacaccaatgttcaaggggaggagcaaaagaaattggatgtgatttctaatgaagtatttgtgaaggccttaatcagcagcggacgcacatgccttcttgtttcagaagaggttgaagatgctatcattgtgccaccagcacagcgtggcaaatacatagttgtgtttgatcctttggatggttcctcaaacattgattgtggagtttcaataggaactatctttggtatttacacagtgaaagatacagctgaagttagcgttgaagatgcattgcaacctgggagcagtttggtagcagctggttactgcatgtatggaagctcttgcacgtttgtgcttagcacaggaaatggagtgaatggtttcacacttgatccttcccttggagagttcatattgactcacccaaacatcaagataccaaagaaaggaaagatttattctgtgaatgagggaaatgctaaaaactgggatgaaccaaccgccaaatacgtagaaaattgcaagtttccacaagaaggttcagcaccaaagtctcttaggtatattggcagtatggtagctgatgtccatagaacattgctatatggtggtatattcatgtaccctgctgataagaaaagcccaaatggaaagctaagggttctgtatgaagtttttccaatgtcatatttgatggagcaagcaggaggtcaagctttcacaggaaaacaaagggcacttgacttggttcctaagaaaatacatgaccgatcgccaatattccttggaagctacgatgaaattgagcatataaaagagctatatgcagaatccaaagaaaatggtgcatgaaaatcaactcaatttctgtttcttttaattgcttaggttccaattcttggtctttttcactcttttggcaattagtaggggaggaatgctatatggtacaaagtgtcacgaatttagaatcatcatctcagggtggatgaagattcatagccttttgtataaataacatttgtacgatcaatc

SEQ ID NO: 247 - DNA, 1377 bp, Medicago truncatula
attgacaatatacaactttttactttttaatacaagaaaataaatacctagcaatataagcgatgacgcacgaacacatatatatctaaagaatttggtacgtacgtagttgattggtttcggttacgattcattcattggaaagaagattttgaagattcatcgaaaatggaccacagcgcagatgcacatcgtacagacttgatgaccataacacgttttgtgttgaatgaacagtctaagcatcctgaatcacgtggagatttcaccatcttgcttaataacattgttcttggttgcaaatttgtttgttctgctgttaacaaggctggtcttgctaagctcattggacttgcaggagagaccaatgttcagggtgaagaacagaagaagctggatgttctttccaatgaggtgttctgcaaggctttgataagcagtggtagaacatgcatcttggtttctgaagaagatgaggatgcaatattcgtggagcctaagcagcgtggaaagtactgtgttgtttttgatccattagatggctcctccaacattgattgtggtgtttccattggaactatttttgggatttatatgatgaaagataaccatgaaccagtcatagaagatgctctgcaaccagggaagaacatgttagcagctggttattgcatgtacggaagctcttgcacgtttgtgataaccactggaagtggtgttaatggtttcacccttgacccttctcttggcgagtttatcctaactcaccctgacattaagatcccaaagaaaggcaagatttattcggtgaatgaagggaacgccaagaactgggatggtcctaccgctgcttatgtggagaaatgcaagtttccaacagatggttcaccagcaaagtctctaagatatattggaagcatggtagctgatgttcatcgtacattgctatatggaggtacctttttgtaccctgctgacaaaaagagtccaaatggaaaacttcgtgtattgtatgaagtcttcccaatgtccttcttgatggaacaggcaggaggtcaggctttcactggcaaggaaagggcacttgatttaattccaacaaaattgcatgaaagatctccaatatttcttggtagctatgatgatatcgaggaaatcaaagctctttatgctgcagaggctaaataagaggatcatgaaaaatttccttttgtttttcactacttgcaagcatttatatccaattgttaggctaacaagtgcctataagaattaaaacttgtttaccttatcatgtatattttataagaaaacctgttaatgtgcttgccatggttatagttttttaattaatggataaacaactttagattagct

SEQ ID NO: 248 - DNA, 1215 bp, Carica papaya
ctcgcgcgctgtaaccgccgaagcagataccaccagacatgaggaagaagaagaagacgaaagccgttaatgatatcttcacagtgacaactgaagaccactccctcactgcctcactcacctcccgccacgtgtctcccccgatcattccgtctcctccaccagataaccctccctgtcccccctcttctgtcatatttatccaattccattcctcgaaccgatcaatattctcgagagaaagatatggatcacgcggcggaggcgcacaggaccgatttgatgaccataactcgcttcgtgctgaacgagcaatccaagcacccggagtcgcgcggtgatttcactatcctcctcagtcacatcgttctcggctgtaagttcgtttgctctgccgtcaacaaggctggtcttgctaagctcattggactagctggagataccaatgttcagggtgaggagcaaaagaagctggacgtgttgtcaaacgaggtttttatcaaggccttgataagcagtggtcgaacgtgcatccttgtctcggaggaagatgaagaggcgacatttgttgagtgctccaagcgtggaaagtactgtgttgtttttgatccattggatggatcctcaaacattgactgcggggtttccattggaacgatttttggaatttacatggtgaaagatgacgaaccaaccatagatgatgttttgcaacctgggaagaatatgttggcagctggctattgcatgtacggaagctcttgcatgtttgtgctgagcactggaggtggtgttaatggttttaccctggatccatctcttggagagttcattctgactcacccagatataaagataccaaagaaaggaaagatctattcagtaaatgaaggaaatgcaaagaactgggatggtccaactgccaagtatgttgaaaattgcaagtttccaaaagatggttcttccccgaaatctctgagatatgttgggagtatggtagctgatgttcaccgcacatttctttatggaggcatctttttgtaccctgctgataaaaaaagccccaacgggaaattgcgtgttctctatgaagtctttcccatgtcattcttggtggaacaagcgggaggtcaggcattcactggcaaggaacgggctcttgacttggttcccaagaagatacatgagcggtctcctatatttcttggcagctac

SEQ ID NO: 249 - DNA, 1926 bp, Arachis hypogaea
aatttccgtcacttgaattactgaaaactcaaaaaaacccaaccgcagcatcaaaatctgagtcactaagcttgaagagaatggaccacagcgcagatgcacaccgtacggacctgatgaccataacacgattcgtgctcaacgaacagtcaaagcaccctgaatcgcgcggtgacttcaccatcttactcagtcacattgttcttgcttgcaagttcgtctgctcttctgttaacaaggctggtctcgccaaactcattggacttgctggagagactaacgttcagggtgaagagcagaagaaactggatgtgctttccaatgaagtcttcatcaaggccttgattagcagtggccgaactagcatattggtttcggaagaagacgaggaagcaaccttcgtggagccttctttgcgtggaaagtactgcgtcgtttttgatcctttggatggttcctctaacattgattgtggcgtttcaattggcaccatatttgggatttatatggtgaacgatgtgaatgaaccaacactagaagatgttttgcaacctggcaagaacatgttggctgctggttattgtatgtatggaagctcttgcacgtttgtgttaaccactggtagtggtgttaatggtttcacgcttgacccatcacttggtgagttcatactaactcaccctgacatcaagatcccaaagaaaggcaagatttattcagtgaatgaaggaaatgctaagaactgggatggtcctactgccttttatgtggagagatgcaagttccccaaagatggttcatcaccaaagtctctaagatatattggaagtatggtagctgatgttcatcgaacattgctatatggaggtatctttttgtaccctgctgataaaaagagtcctaatggaaaactacgtgtactatacgaggtatttccaatgtcatttttgatggaacaggcagggggacaagcattcactggcaaacaacgggcacttgatttgattcctaagaagttgcatgagagatctcccatattccttggaagctacgatgatgttgaggaaatcaaagctctttatgctgctgaggccaagtaggaatcaccctaaagagtgtcctttcgccatgcactcaatccatgcatcttagaacaaattgtgaataaagaataaattgattgagataacatggatattaatgaaagaaggataactgcatccttttctttcaactggctgtcatagtttcaatcttatagcattaaggcatactagtttctctcataatggtatcaactctttcaagaaatgagacttatcaagaatcatatctatggagcaacttagaagtaaagacaatgctgcactgccaccaagagtctagtcatgtacatgctgtgattctcatgctcaataaaactaaaatctgtctcaaacagaaatgaaccactagcaaacacggcaattaagggactaatctaatcataaccactatcttaacaagctaatacattttcagcaagattgataatcttcattaaaatgaatacaaagattccctccatgtcaattgtcatgcagtcctcagcggcggggaaaccaatatcactccatctcccctaacaaacaagaaaggaacagtacgccttgtcgtcctcacaatttcttcgtatgtttcatcatcaatttcaacagtagtaacaatttcttcaacatcaccaaggatcatattaagatgctgatcgtaagcatgaagtttgccgcgaagttcacggtcggaacggagcttgacatagatgcgctcgtcgaggctcagccttatcagatccaaaggctccttcacagcgctttcttcttctgcagcagccattgctctctctctctctctctcttcgaagacagagagactcccacacacacagtc

SEQ ID NO: 250 - DNA, 1182 bp, Arachis hypogaea
aaaggttggaacttggaatttggaaggaagatggatcacagcgcggatgctcaacgcacggacctcatgacaataacgcgattcgtgttgaacgagcagtcgaagcaccctgactctcgcggtgacttctccattctgctgagccacattgttcttggctgcaagtttgtgtgctctgctgtcagcaaggctggtcttgcaaagcttattggactcgccggagacaccaacgttcagggcgaagagcaaaagaagctcgatgtgctttccaatgatgtattcgtcaaggctttggttagcagcggccgcacgagcatcttggtgtctgaagaagatgagcaagcaactatcgtcgagccttccaagcgtggaaaatactgtgttgtttttgacccgctggatggttcctccaacattgattgtggcgtttctattggcacgatatttgggatctatatgctgaaagatgagcacgaaccaaccttacaagacgttcttcaacctggcaagaacatgttggcagctggttattgtatgtatggtagctcttgcacgcttgttataagcactggaaatggtgttaacggttttacccttgatccatcacttggagaattcattctaactcaccctgatattaagatcccaaagaaaggcaagatctactctgtgaatgaagggaatgcaaaaaattgggacgctgccacaaccaaatatgtggagaaatgcaagtttccaaaggatggttcgtcaccaaaatctctaagatacattggaagcatggtagccgatgttcatcgcaccctgttgtatggaggtatctttttgtaccctggtgataaaaagagtccaaatggaaaactacgtgtgctatatgaagttttcccaatgtcattcttgctagaacaggcaggaggccaagctttcaccggcaagcaacgggcacttgatttggttccaaacaaattgcatgagcgatctccaatattccttggtagcttcgatgatgttgaggatatcaaagctctttatgctgctcagtctcagggctaagattgtatctcccccactacttattaaaaccaattgttaatatctatcatcacctcatgtatattttattttaagcatacttttcataatatttctgctactatatatgatagattttattgatggttt

SEQ ID NO: 251 - DNA, 1298 bp, Capsicum annuum
gcacgaggattgagttgtgggaaaatcaagaagagggtagagatggatcacgcagcggatgcacaccggacagatttgatgaccataacaaggtttgtgttgaatgaacaaaccaaacatcctgaatcacgtggtgatttcagtatcttgctcagtcacattgtccttggctgcaagttcgtttgcagtgccgttaataaggcaggtctggccaaactactaggacttgctggtgagacaaatgtgcagggagaagatcaaaagaagctggatgtactctcaaatgaagtgtttatcaaggctctggttagcagtggccgaacatgcattcttgtctccgaagaagacgaagaggctacatttgtggagccagctaagcgtggaaaatactgtgtagtttttgatcctctggatggttcctcgaacatcgattgtggtgtttctattggaacgatctttgggatttgcatgattaaagagggtcatgaaccaaatctagaagatgtcttgcaacctgggatgaacatgttagccgccggttactgcatgtatggaagttcttgtacgctagttttgagcactggatctggagttaatggttttacccttgatccctctcttggcgagttcatcctaactcatcctgacatcaagattcctaagaaagggaagatctattcagtaaatgaaggaaatgccaagaactgggatggtccaacaaccaaatatgtgcagagctgcaagtaccccactgatggttcttctccaaaatctttgagatatattggaagtatggttgctgatgttcatcgtacattactctacggaggcatcttcttgtaccctggagataagaaaagtcccaacggaaaactgagggttctctacgaagtatttcccatgtcatttctgatggaacaagcaggaggccaagcatttactgggaagcagcgcgcgctcgacctagttccagagaagatacacgaacgttctcctatatttcttggtagttatgatgacgttgaggagatcaaaaagctctacgctgctgaagagaaaaactgatggaagtgtttataccctgtaatcacttcactactctcagcttggtggtgcagataacaaatttctcaaattagagcaagttatgatgactacattgtttactgtttatgttgcagtgtagctactttgacgcgataatacgttcacattacttgctcttttctcaaactcccaaagtatccatttctcatcaacaataaaaggtttaatagagaagttctggcttattattg

SEQ ID NO: 252 - DNA, 1480 bp, Capsicum annuum
gcacgaggcgtagctcccccttgtctctccacgtgtcatatgaaacttgcattgacatcagatacccccaagtaccaatcccgttcattttcccaggttacccttttatcgacactaattatttattgcatgatcactcgtgtcaacatcgaattgcgtgccaccctaattgatatacatacaattgtactactactataaactactgctttattgctggagtattggaggggaagaagaagaaggaggaattgaagagttatcggatatggatcacgcagcggatgcgcatcggacagatttgatgacaataacaaggttcgtgttgaatgagcaaactaaatatccagaatctcgcggcgacttcactatattgctcagtcacattgttcttggctgcaaatttgtctgtactgctgttaacaaggcaggtttggccaaactccttgggcttgctggtgagactaatgtgcagggtgaagaccaaaagaaactggatgtactctccaatgaagttttcatcaaggctttggtcagcagcggccgaacatgcattctcgtgtctgaagaagacgaagaagctactttcgtagagcctgctaagcgtggaaagtactgtgtagtttttgatcctctggatggatcttccaatattgattgtggcgtttctatcggaacgatctttgggatatacatgatgaaggatgctcatgaaccaacactagatgatgtcttgcaacctggaaagaatatgttagctgctggatactgcatgtatggaagttcttgtacgcttgtcttgagcactggaaaaggtgttaatggttttacacttgacccctctttaggcgagttcatcttaactcatccagaaatcaagattcctaagaaaggaaagatttattcagtgaatgagggaaatgccaaaaactgggatggtccaacatccaaatatgtggagagctgcaagttccccgaggatggttcttcacccaaatccttaagatatatcggaagcatggtagctgatgttcatcgtacattactctatggaggtatatttttgtacccagctgataagaaaagccccaatggaaagctgcgggttctctatgaagtatttcccatgtcatttctgatggaacaagcaggaggccaagcatttaccggaaaagagcgggcactggacttagttcctacgaagatacatgaacgggcaccaatatttcttggtagttatgatgatgtggaggagatcaaaaagctttatgctgctgaagagaaaaattaatggatgcatatttacaatcatcctctcactttacaattcttgctgatgctcattactaatttgttgaaatagagcaaatttctgtttgttaccaagtcacaaaatcatcaatattacaacatatgtatgttgcacattagcttgttggctactgtcaaacaataatacgagcatatatgagcctcgtgc

SEQ ID NO: 253 - DNA, 1711 bp, Physcomitrella patens
gcactgttggcctactgtgtttctaatcaggagctcctcgcttttgtaaaagttgagcgtcgtcttttgcgtcaagcattcctctcgaggttctagtcgtgaagctagttttgtggaaggaactgtgcagatctcgtagccatggatcacgctgcggatgctatgaggacggatctaatgaccattactcggcacgtcctgaatgagcagagtagatttccagaggctcgtggcgatctcacaatcctccttaacaacatcgtgctgggctgcaagttcgtgtgctcctccgtgagcaaggctggattagctaaacttattggattggcaggagaaaccaatgtgcagggcgaggagcagaaaaagctcgatgtcttgtcgaatcatgtcttcatcaacgctctcgttagcagtggacgcacaaatgttcttgtgtctgaagaaaacgaagaagcgatttttgtagagtcctctaaaagagggagatactgcgttgtgttcgatccacttgatggatcttccaacatcgactgcggagtttctattggaacgatttttggaatctatatgctcaaggaaggagcatcaggcactgttgaggatgtgttgcagcctggcactgcaatgcttgctgctggctattgtatgtatggaagttcatgcaccttggtactgagcacaggtgcaggggttaatggattcacccttgatccctccctcggagaattcatcttgacgcaccctaatatcaagattcccaaaaagggcaagatttactctgtgaatgaaggaaatgccaaacactgggacgggcccacaacgaagtatgtggagaacgccaagtttcccaaggatgggtcatcacccaaatcattgcgatacattggaagtatggtagcagacgtccacagaactctactttacggaggtatctttatgtaccctggtgacaagaaaagccccaaaggaaagctcagagttctgtacgaggttttccccatgtctttcttggtggagcaagctgggggccaatcctttactggcaagcagcgtgctctcgaattggtcccagcacatatccatgatagatcacccattttcttgggaagctccgatgatgttgaggaaattaaggctctatatgcggctgaatctgcctagatgtatgccaaggcggcatgaaaaatgtcaccaacctgagagcgctttagttttcaaaaccgtatagaaagtatcggctcaaagccggtgaattgtaattcctttttggaggacctgacaattctcagattttttttaatttgtagttttaattacttacggaggtgtctcagtctacaatgattgtgggactgtaaagttctcacaatttgacatccgttttcgaatttaaaatgtgaaaaaactgtctaagagatctcatatagtcctaaatctatctttagttctcgacatattcatatctacagtgttgtaggaatgaatcaaaagctttctgagattacaggtgaaatctcgtcgattagaatcacaataagtttcagaagtggaattgcaccgttttgccgtttatgactcaattctatgaagattgtttcattccgtataagtagtagcatcgcaaaacgtcttatttaaatgatttgtatggagtgagcaacccagcgaacaatgaaccagttgcaggagaatgaacatctgaaaatcagac

SEQ ID NO: 254 - DNA, 1359 bp, Physcomitrella patens
tcgagcctgttggcctactgtctgacgcggcgctgaacttcctttctcgcgttcacaattgcctccgagaggtgttcgtcgtgaagctagatctgcgaagtgaactgggaagatctcgcagccatggaccacgctgcggatgcaatgaggactgacttgatgacaattactcggcacgtgctcaatgagcagagcaaatttccagaagctcgtggtgatctcacgattctccttaacaatatcgtgcttggctgcaagtttgtttgctcgtccgttagcaaggctggattggcgaaactcatcggattggcaggagagacgaatgtacagggagaagagcagaaaaaactggatgttttgtcgaatgatgtcttcatcaacgctcttgtgagcagtggacgcaccaatgtcctcgtatctgaagagaacgaagacgcaatttttgtagagccgtccaaaagaggaagatactgcgtcgtgtttgatccacttgatggatcttccaacattgattgtggtgtatctattggaacgatttttggaatctacatgcttaaggaaggagcctcagggacggttgaggacgttttgcagcctggcactgctatgcttgctgcaggctactgtatgtatggaagctcatgcacattggtactgagcacaggtgctggggttaatggcttcaccctcgatccttcacttgggggagttcatcttgacgcaccctgacatcaagattcctaagaagggaaaaatttactctgttaacgaaggaaatgccaaacactgggacggtcctacaaccaagtatgtggagaacgcaaagttccccaaggacgggtcatcgccgaagtcgttgagatacattggaagtatggtagcggacgttcacagaactcttctatacggaggtatctttatgtaccctggtgacaagaagagccccaagggaaagctcagggttctgtatgaagttttccccatgtctttcttggtagagcaagctggaggtcaatccttcactggcaagcagagatccctcgatctggtcccagctcacatccacgacagatcacccattttcttgggaagctacgatgatgttgaggagattaaggctctatatgcagctgaatctgcttaggtcaatgccgctcacctgtcagatctacagttataagaattatgtggaaaatttgctcaaaggaaaggaaattttcttcattggaagagctgaaaatctcagttatcttttttaataactgtgattatttatgagcagtgtttactgcaattgcaagagagtaaaagtctctcataatgtagtatctgttctcaaatctgaactgtgaataaatg

SEQ ID NO: 255 - DNA, 1825 bp, Pinus taeda
gagccagcttacctcagaaacaactgaaaggccactgttcaaattccaagacacgtgtgttttccacttattccaagactaaataacgtgaggtggcgctccacgtcagcaccatactccactttacgcaatgtcgaagtcgaataaactacaatgcagggggctctctaaattctacagcagagtgtggaggcacacgggcacagatcagatcagctcatttcatctcaataatcgcaactgagaagaatggatcacgcggcggaagcccatcgaacagacttgatgactattacccgctttgtgctaaatgaacagtccaagcatccggaagctcgcggggatttcacaattctgctgagccacatagtccttggctgcaaattcgtatgctcttgtgtcagtaaggcaggacttgctaggctcattggtcttgcaggagaggtcaacgtgcagggagagcaacaaaaaaaattagatgtactatcgaatgaagtattcatcaaggctctcataagcagtggacgtacgagcattcttgtttctgaggaggatgagcaggcaacctttgttgagccatcaaaacgagggaggtactgtgtagtttttgatccgcttgatgggtcctccaacattgattgtggagtatccattggaacaatctttggaatatacatgcttaaggatgatagtgaagggaccttgaatgatgtgcttcagccggggaaaaaaatggttgcagcaggatactgtatgtatggaagctcttgcacgcttgtcttgagtactggtacaggagtaaatggttttacacttgacccctctcttggggaattcattttgactcatccaaacataaaggttccggagaaaggtaaaatctattctgtgaatgaaggcaatacaaaaaactgggatgagcctaccaagaagtatgttgagagatgcaagtttcctgaagatggatcatctccaaagtctcttagatatattggaagcatggtagctgatgttcacaggacgcttctgtatggtggcatattcatgtaccctgcagataagaagagtcccaacgggaaattacgtactctctatgaagtgtttcccatgtctttcttaatggagcaagcaggaggtcaagcctttacaggcacaggacgagcactggatatagttccaaccactattcatcagcgttctcctatcttccttgggagctttgaggatattgaagagattaaatctttatatgctgcttatgaagcaaagaccttctaggttcgttttccaggtacattgtacttttttcatgaactgatttaagagtacagtcatgaggtattgaagacttcaagaacatagagttcctcaagtacgagttctgttaaaagcttgtaaaagatgccagctttagacggtttggtaagctgtggagagtctccagtcttgctaaacattactcaaattataaaatagccctttggctgtcggctgcaatgaaatagagctgtaaaggattgtgtctgacaatattgttggagactgaatttttgcccatgacaatgccttcgttataaatctcacgtaccttctcccgagtaggcatttgcttatgttgaagttgatacaaaggtaattttgaggacatgggataactaacatgttactgttgttaatggtgtctgtgtatttacacacacggatttagctatattgagtatgatgtaatgacaataatttattacgtccacaggtaattctggggacataggataactaacattttaaggtatattatatataatggcaataatttattatgtct

SEQ ID NO: 256 - DNA, 1381 bp, Pinus taeda
gcggggataacacttcggtattaacggacagaccacaggcagagaggaagaggctgaatttaattgaatttggaggaaagaacatggaccacgcggcggatgcctatcgcacagatcttatgaccataacgcgattcgttctgaacgagcagtctaagcatcctgaatcgcgaggagatttttccattttgctcagtcgcattgtcctcggatgcaagtttgtgtgctctgccgtcaacaaggcgggtctggctaaactcattggccttgcaggggagaccaatgttcagggggaagaacaaaagaaattagatgtgctctccaatgaagtatttgtcaaggctcttgtcagcagtggacgcacgtgcattttagtttcagaagaggatgaggaggccacctttgtggagcattcacagcggggaaagtattgcgtagtcttcgatccactcgatggctcttccaacatcgattgtggagkgtcaattgggacgatatttggaatatacttggtgaagaaagaaggagaggcggccctgagtgatgttctcaaaccaggcaagaacatggttgcagcaggttattgcatgtacgggagttcctgcacgcttgtgctgagcagcggcagtggtgtaaatggctttacactggacccctcccttggggaattcattttgactcatcccgacataaagataccaaagaaaggaaaaatatattcggtgaatgaaggcaatgcaaagaactgggatgagccaaccaggaagtatgttgagagatgcaaatttccccaagatggatcatctcccaagtctctcagatatattggaagcatggtagctgatgtgcacagaaccttactctatggcggtattttcatgtaccctgcggataagaagagtcccaatggaaaattgcgtgttctgtacgaagtgttccccatgtcgttcttaatggaacaagcaggaggtcaagcttttacaggaagcatacgagcacttgatctggttcccactaagattcaccaacgttcccctatctttcttgggagttatgatgatgtggaggagattaaggctctgtacgcagcacaggaagggaaggtttaaaagtccgtccatgaataggcaattgtattttctaaggattgatgactaattttagaaacaaaaaatatgaatgcccagaagaaaacattattttttcattattttttaagcaagccaaaccacgaaatatgtaatgtcactgaattctcatatttgtaccatgcagtatatgtgtacttgtacatgcatatagtgcgtgtccataacaagtctgtattttaatgtgaaaagttaatattaaaccgtttatggttattttcaaccgaaaaaaa

SEQ ID NO: 257 - DNA, 1623 bp, Populus trichocarpa
atcctcaaaacacgaacagaaccaaaacagaaacctcataaccgtccaatcagagataaacgacggaaggtgttatctgcagcgacggccacacacctcagtctctcactctcttgtctccacgtgtcctccgaaacttccgtttacaccagatagccccatcccctctctctcatcgctttcatatttatcttctcctctcgaactgaccaacacgcattctcgtcaataaaaaaaatactcaaattatattacaaaccggattcgaacaagtttttgagagagagagagagagagatggatcacgcagcagatgctcacaggacggacctgatgaccataacgaggttcgtgttgaacgagcaatccaaatatcctgagtcgcgtggtgatttctctattctgctaaatcacattgttcttggctgcaagttcgtttgctctgtcgttaacaaggcgggtctagccaaaattattggacttgctggggagactaatgttcagggtgaagagcaaaagaaacttgatgtcctttcaaatgaagtgttcatcaaggctttagtaagcagtggccgaacatgcatccttgtctcagaagaagatgaagaagcaacatttgtggagccttccaggcgtggaaggtactgtgttgtgtttgatccattggatggatcctccaacattgattgtggtgtttctattggaacgatttttggaatttacatggtgaaagatgaccatgaaccaactctagatgatgtgttgcaacctgggaaaaatatgcttgcagctggctattgcatgtatggaagctcttgcacgtttgttttgagcactggaactggtgttaatggtttcaccctggatccatccctcggagagttcatactcacacaccctgacataaagattccaaagaaaggaaagatttattcagtgaatgaaggaaatgtgaggaactgggatggtccaacagccaagtatgttgaaaaatgcaagtttccccaggatggttcctcagcaaaatctctaagatatattggaagcatggtagctgatgtccatcgcacattactttatgggggtatatttttgtaccctgccgataaaaagagccccaatgggaaactgcgtgttctatatgaagtcttcccgatgtcctttttgatggaacaagcaggaggtcaggcttttactggcaagcaacgggcactggacctacttccgacgaagatacatgagcgctctcctatatttcttggaagctatgatgaggttgaggaaatcaaagcactctatgccgctgaagagaagaaagcataaacacctatgctgtggctctgtttggtatggcgctgcaccactctgtggtcaacggggctaccgtgtcaaaattagcgcaatgccgagcaggggttgttattaccactgtcttatagaactcgtaatacttctgtctgtgggcatctgacctacttctaatcatctatctattcattagataacgtgttttcatgatgttcttctgatgtgttcattgatgggataaacaaaccagttggctgatattagaataatgagaaaggatgcaatacatgaccacgtgaatttttccatgctgga

SEQ ID NO: 258 - DNA, 1235 bp, Populus trichocarpa
gtaaagagagaaagagagatggatcactcagcagatgctcacagaacggatttgatgaccataacgaggttcgtgttgaacgagcaatccaagtatcctgagtctcttggtgatttctctattttgctcaatcacattgttcttggctgcaagttcgtttgctctgctgttaataaggcgggtctagccaaacttattggacttgctggggagaccaatgttcaggcaagttagcaaaagaagcttgatgttctgtcaaatgaagtgttcattaaggccctagtaagcagtggccgaacatgcatccttgtctcggaagaagatgatgaagcaacatttgtggagccttcaaggcgcgggaggtactgtgttgtatttgatccattggatggatcctccaacattgattgtggtgtttctattggaacgatttttgggatttacatggtgaaagatggccatgaaccaactctaaatgatgtgttgcaacctgggaagaacatgcttgcagccggctattgcatgtatggaagctcttgcatgcttgttttgagcaccggatctggtgttaatggtttcaccctggatccattccttagggagttcatacttactcaccctgaaataaagattccaaagaaaggaaagatttattcagtgaatgaaggaaatgcaattaattgggatggtccaacagccaagtatgttgaaaaatgcaagttccccgaggatggatcctcagcaaaatctctaagatacgttggaagcatggtagctgatgtccatcgcacattactttatgggggtatatttttgtaccctgcggataagaagagccccaatgggaaactgcgtgttctatatgaagtcttcccgatgtcctttttgatggaacaagcaggagggcaggcttttactggcaagcaacgggcactggatttagttccaacgaagatacatgagcgctctcctatatttcttggcagctatgatgacgtcgaggaaatcaaagcactctatatataatgctgaagagaagaaagaataaacacctatatatactgtggctatatttgttatggcgctgcaccatgccagaatgctcgaaattccgaagggggttatttgttattacttgtattatagtactcataatattttcatagcctttaattgttctatgggcatttgacctgtttctgataatctatttcatcagaaaaagcgttttcatt

SEQ ID NO: 259 - DNA, 1488 bp, Solanum tuberosum
aaatcagttaacagaatgacgaattggatcacgctttatcttagtgccaaccactgatcccatgcatcactctgctctttccacgtggcatcctctgacgtcagatcagattcctcttctttcttttttttttctgtatatatatgagcattttagtagtactgcgtgcccaatctcttacataaaaatcgaagcacgatggatcacgcggcggatgcacaccggacggatttgatgacaataacaaggtttgtgttgaatgagcagacgaagcaccctgaatcccgtggagacttcagtattttgctcagtcacattgttcttggctgcaagttcgtatgcactgctgttaacaaggcaggtttagccaaacttctaggacttgctggtgagactaatgtgcagggagaagatcaaaagaaacttgatgtactctcaaatgaagtgtttatcaaggctttggttagcagtggccgaacatgcattcttgtctctgaagaagatgaagaagccacatttgtggagccagctaaccgtggaaaatactgtgtagtttttgatcctctggatggatcatcgaacatcgattgtggtgtttctattggaacgatctttggaatttacatgatcaaagacggtcatgaaccaacactagatgatgtcttacaacctgggatgaacatgttagctgctggttactgcatgtatggaagttcttgtacgctagttttgagcactggatctggagttaatggttttacccttgatccctctcttggcgagttcatcctaactcatcctgacatcaagattcctaagaaagggaagatttattcagtgaatgaaggaaatgccaagaactgggacggtccaacatccaaatatgtgcagagctgcaagtatcccgctgatggttcttcaccaaaatctttgagatatattggaagtatggttgctgatgttcatcgtacattactctatggaggcatcttcttgtaccccggagataagaaaagccccaacgggaaactgagggttctctatgaagtatttcccatgtcatttctgatggaacaagcaggaggccaagcatttactgggaagcaacgggcacttgacttagttccagagaagatacacgaacgctctcctatatttcttggtagttatgatgacgttgaggagatcaaaaagctctacgctgctgaagagcaaaactgatagatgtatctataccatgtaatcacttcactactcttgctggtgcagatatcaaatttctcaaattacagcaagttgttactgtttatgttgcacaatagctgctgtgacgcgataatacgttcacattactggcttgttctaactttttttcttgaagtatctatttctcatcaacaataaaatgttgaatagagaagttctggcttattattgttatcaaagttcttttgtaatgtcatccatttagaatcaagctaatttttt

SEQ ID NO: 260 - DNA, 1540 bp, Prunus persica
cagagctcactgccccatcccaggccctccacgtgtcctccgaaacttctattagtaccagattagccccttcccttcccaatccattaacacctcgaatcgagtaccaccaccaccatctaatccaaatctaaacgactattttgactcaaaaaaaagaaaaaaagaaaaaaaaaaggactatttatttatttttctgtaaatgttttttgggggataaatatatatatatatatttatttggccattggkgggttttgtgtttttggtttctgaagtttttagtgacagtggtggtggtggattgtggagagagagagagagagaaataggcgaaaatggatcacgcggccgatgctcaccgtacggatttgatgaccataacgrggttcgtgctgaatgagcagtccaagcaccctgagtctcgcggagacttcaccatcttgctcaatcatattgttcttggctgcaagtttgtctgctctgctgtcaacaaggcgggtctggccaaacttattgggcttgctggagagaccaacgttcagggtgaagagcaaaagaaactggatgtgctttcaaatgragtttttgttaaggccctggttagcagtggcagaacttctatccttgtttcggaggaagatgaagaggccatatttgtggagccatccaagcgtggaaagtactgtgttgtatttgatccactggatggttcgtctaacrttgattgtggtgtttccattggaacgatttttgggatttatgtggtaaaagatggcattgaacctactctgcacgatgtcttgcaacctggaaagaatatggttgcagcaggctactgcatgtatggaagctcttgcacgtttgtattgagcactggaacaggggttcatgggttcactctggatccatctcttggggagttcatactaactcacccagacatccagattccaaagaaaggaaaaatctattcagtgaatgaagggaatgccaaaaattgggatggtccgacggccaagtatgtggaaaagtgcaaatacccgaaagatggttcatcaccaaagtctctaagatacattggaagcatggttgctgatgttcatcggacactgctttatggaggtatctttttgtatcctgctgacaagaagagcccaaatgggaaactgcgtgttctctacgaagtcttccccatgtctttcttgatggaacaagcaggcggtcagtcattcactggcaaggaacgggcccttgacctagttccaaacaagatccacgagcgctctccaatcttccttggcagctatgatgatgttgaggaaatcaagacgctctacgccgcagaagggaagaagtaatgaacttataattctgtttctgttacagtaattacataaatgttcagctatctgaacttccatctattaaatcaagctgtaaagagagcgtacaataatttcttgacgtgtacaactctaacaaggttatattcttatgttttgaattatagcctcacaacgttttttggctaaaaaaa

SEQ ID NO: 261 - DNA, 1195 bp, Raphanus sativus
agacgagagagaggatcaaagatggatcacgaagcagatgcataccgtacggatttgatgaccataacgaggttcgtgctgaatgagcaatcaaagtacccagagtctcgtggtgatttcaccattttgctcagcaacatcgttttgggatgcaaattcgtctgcagtgctgtcaacaaggctggtttggccaagctaattgggcttgctggggaaacaaatatccagggtgaagagcaaaagaaactcgatgtgctctctaatgatgtctttgtcaaagctttggttagcagtggcagaacttctgttcttgtctcagaagaagatgaggaagcaacgttcgtggagtcatccaagcgtggaaagtactgtgttgtttttgatccacttgatggatcctcaaacatcgactgtggtgtttccattggaaccatctttgggatttacacaatgagccacaatgatgagccaactactgaagatgtcttgaaacctgggaatgaaatggttgctgcgggttactgtatgtacggaagctcctgcatgcttgtgttgagcactggaactggtgtcaatggatttaccctggacccatctctaggagagttcatattaactcacccggacattaagattccgaaaaaggggaacatctattcagtgaatgaaggcaatgctcagaactgggatggtccaaccacaaagtatgtagagaaatgcaagtttcctaaagatggttctcccgctaagtctctgagatatgtgggaagtatggtagctgatgttcatcgcacactgctttatggaggaatcttcttgtacccggctgacaagaaaagccccaatgggaaactgcgtgttctgtatgaagtcttcccgatgtcgttcttgatggagcaagccggaggtcaggccttcactggcaagaaaagggcgctagaccttgtgcccgagaagatccatgagcgttctccaatatttcttggtagctacgaagatgtagaggagattaaggctctgtatgctgcagaggactaagattctcattcttcttattttattacttgtctctcccttatttctatatcttcttctattgagacaaacaaacgactcatttatacaagggagactttttctcatcttttttcaacgcacctaagatatatatttttcattttacaaaaaaaaaaaa

SEQ ID NO: 262 - DNA, 1193 bp, Raphanus sativus
agataacatagagagtgagtgagtgtcagagagagagagaaacagagatggatcacgaagcagatgcgtaccgtacggatttgatgacgatcacgagattcgtgctgaatgagcaatcaaagtacccagagtctcgcggggatttcacgattttgctcagcaacatcgttttgggttgcaaattcgtctgcagtgccgtcaacaaggctggtttggccaagcttattggacttgccggggagacaaatatycagggygaagagcaaaagaaactggatgtgctctctaacgatgtttttatcaaagctttggttagcagtggtagaacttctgttcttgtctcggaagaagatgaggaagctacgtttgtggaatcatccaagcgtggaaagtactgtgttgtttttgatccacttgatggatcctcaaacattgactgtggtgtctccattggaacaatctttggaatytacacgatgaaccacagtgatgagccaagtaccgaggatgttctgaaacctgggaatgaaatggttgcagcgggttactgtatgtacggaagctcctgcatgcttgtgttgagcactggaacaggtgtccacggatttaccctggacccatctctaggagagttcatattaactcacccagacattaagattccaaataagggaaacatctactcagtgaatgaaggcaatgctcagaactgggatggtccaaccacaaagtatgtagagagatgcaagtatcccaaagatggttctccagcaaaatctcttagatatgtcggaagtatggtagccgatgttcatcgcacgctgctttatggaggaatcttcttgtacccggctgacaagaaaagccccaatgggaaattgcgtgtcctgtatgaagtcttcccaatggcgttcttgatggagcaagctggaggtcaggccttcactggcaagaaaagggcactggaccttgtcccggagaagatccatgagcgttytccgatatttcttgggagctacgatgatgtagaggagattaaggctctgtatgctacggaggagaagaactaagctttccattgtaatatcgtatttctacatcttcttctgttgagacgaaccatttgactcgactcatgtatgccaaggagactggtttaaaaaaaaagataataataatatataacttttttc

SEQ ID NO: 263 - DNA, 1645 bp, Oryza sativa
acctggggggccaaacgcgacgaccacaaacgcacacggccaccgcgctaccagccatcgcggatagaggggataggcctccgcgccgattccgttggagctcctcgcccctcggctcccagcctcactttctcccctcgctacctcccaaaacccctaaaaaaaacgcccaatacgtacaccgcgcccgcgtcacgtcacctcaccgggtcagttcccgcgccgtgtgaccaatactcaacacttaaaccgcgcgctttttagccgacccgagcagccggagagtgaggcgaggcgaagcgaagggaagagcgcgaggcagagtaagcagacgagaagaacagcgcgcggcgcggtagctgaggagagtggtgcggagatggatcacgaggcggacgcgtaccggacggacctgatgacgatcacgcggtacgtgctgaacgagcagagccgcaacccggaggcacgcggcgacctcaccatcctcctctcccacatcgtgcttggctgcaagttcgtcgcctccgccgtcaacaaggccgggctcgccaagctcatcgggctggccggcgagaccaacgttcagggagaggagcagaagaagctggacgtgctgtccaacgaggtgttcgtcaaggctctcgtcagcagcggccgcacctgcgttcttgtctccgaggaggacgaggaagcgacgttcgtggaccctgcgctgcgtgggaagtattgcgtgtgctttgatccactcgacggctcctccaacatcgactgtggcgtctccatcggaacgatctttgggatctacatgatcaaagataaggagaatgtgactcttgaggacgtgttacagcctggaaaaaacatggttgctgctggatactgcatgtacggcagttcctgcacgcttgttctgagtactggaaatggtgtcaatggcttcacacttgatccatctctcggggagttcatattaactcatccagacatcaagataccaaagaaagggaagatttattcagtgaatgaagggaatgcgaaaaattgggacgagcctaccgcaaagtttgtggagaagtgcaagttccctaaggatggttcatcacctaaatccttgagatacattggaagtatggttgctgatgtccaccgtacgttgctatatggaggagtatttttgtaccctgcagacaagaagagcccaaatggaaaactccgtgttctgtatgaagttttccccatgtcattcctgatggagcaggctggaggccagtctttcacaggcaaagaacgggctcttgacctcgttcctaccaagattcacgagagatccccaatatttcttggaagcttcgaagatgtggaggagatcaaagggttgtacgctgcacaggcgaagtaagctcggtttgatcgatctggcaccatcaaggcgtgcgaatggactccctggccttactgtaacatgcatgattcgtcaggcacttcttttattcgtcttactgtacgtttgtaaaattcagtgtaatagtgttgaggcctggaacagcttcatgagcaactaaggccttttctactattatttacaaaatacatacaccgtgcatctctagcagctaaagcactaatacaacaagtcactaaggca

SEQ ID NO: 264 - DNA, 1389 bp, Oryza sativa
atgcccactccgctcgcttaacacacctgcccgaattcgtccaatccatctgcacccgcgcccgtgtccctctcgcgccacaggacaaggcctcccgaccgccgctacctcctcatctcctctccgagtcctcgcacggtcgtcacagtcacccccagaactcagctaagctcgcgttcgttttcgcaaggagcagaggaggaggggagagatggatcacgcggcggaggcgcagaggacggacctgatgacgatcacgcggcacgtgctgaacgagcagggccggcacccggagtcgcggggggacttcaccatcctactctcccacatcgtcctcggctgcaagttcgtcgcctccgccgtcaacaaggccggcctcgccaagctcatcggcctcgccggcgacaccaacgtccagggtgaggagcagaagaagcttgacgtgctctccaacgaagtcttcgtcaaggcgctcgtcagcagcggccgcacgtgtgttcttgtgtctgaagagaacgaggaggccattatcgtcgacgctcccctccgcggaaagtattgcgtttgttttgatccactggatggctcctcaaatatcgattgtggtgtctccatcgggacgatctttgggatttacatgattaaagacaaggacaacgtgactttggacgatgtactgcaacctggaacagacatgcttgctgctggctactgcatgtacgggagttcatgcacgcttgtgttgagcactggaaatggagtaaacggtttcacccttgatccttcccttggggagttcattctgactcatccaaacatcaagataccaaatagaggaaagatctattcagtgaacgaagggaatgcgaaaaattgggatgctcctacagcgaagtttgtggagaaatgtaaatttccccaggatggttcgccttctaaatccttgagatacatcggaagtatggttgctgatgtccaccgtactttgctatatggaggcatatttttgtaccctgcggatcagaagagcccaaacggaaaacttcgtgttctgtacgaagtgttcccaatgtcattcttgatggagcaagctggaggacaagctttcacaggcaaacaacgggcccttgaacttgttcccagaaagattcatgatagatctccaatattcctggggagctatgatgacgtggaggatatcaaagcattgtacgcttcagagtctatcatcggttgaccggtgttactgaagagtaaaaggacacatgaatcaccctctaccttgtgaacatagacatttttttttgctttaatgtaaaaaaatcagcctatactgacacggtacggcttcaccaatatgaaagaataaaggaatatgattcttacata

SEQ ID NO: 265 - DNA, 1908 bp, Sorghum bicolor
ccctgccactgccagctagctcccgcgatcggcgccccgcggggagctcgagctagtgtaaatataccgtgggcggcgggaggatcagcagagccggttcgttcgtcgtgccccgcgcgctctgcactgcgtggtcaccaccaccaacaccaccaccaccagctaaggtagccgaagagagccagggagcgaagcggagcggaggcgagatggaccacgcggcggacgcgcaccggacggacctgatgaccatcacgcggcacgtgctgaacgagcagagccggaacccagagtcccgcggcgacttcaccatcctgctctcccacatcgtcctcggctgcaagttcgtcgcctccgccgtcaacaaggccgggctcgcccagctcattgggctcgccggcgagaccaacgtgcagggagaagagcagaagaagctggatgtcctgtccaacgaggtgttcgtcaaggccctcgtcagcagcggtcgcacctgcgtccttgtgtccgaggaggacgaggaagcaacgttcgtggaccctaagctacgtggaaagtattgtgtttgctttgatcccctcgacggctcctccaacatcgactgtggcgtctccatcggaacgatctttgggatttatatgatcaaggacaaggacaatgtcactctggccgacgtactgcaaccaggcaaggacatgcttgccgctggatactgcatgtatggcagttcctgcacgcttgttctgagcactggaagtggtgtcaatggcttcacacttgatccttcacttggcgagttcatactaactcacccagacatcaagatacctaagaaggggaagatttattcagtcaatgaagggaacgccaaaaattgggacgtgcctgttgcaaagtttgtggagaagtgcaaataccccgaagatggtacgccaccaaaatctttgaggtacattggaagtatggttgctgatgtgcaccgtaccttgctatatggaggtgtatttttgtaccctgctgaccagaagagcccaaatggaaagctccgcgtcctgtatgaagttttccccatgtcattcctaatggagcaggctggaggtcagtccttcacaggcaaagaacgggctcttgatctagtcccaaccaagatccacgacagatccccgatattcctcggcagctacgacgatgtggaggaaatcaaagccttgtatgccgagcaggcaaagtcaagctcggcttgatcagcgaacccaaatgaggtgtaaatcgacctgattcagacatttcttcccttggtgtcgtcgtaagtttgtaacattcagtgtaatatatagtatgggggcccggaacagcttcacaagcaactaaggtcctccgaaaaaagttacatactcatagtttgattcgagttatccataaattatatacatacatgcatgcacatatgcatctctagcacctaaaagccttgtgttattaccaacctaagcatacttatagtttgcttcgagttatccacacacgctaagtgctcaggtgtcatatataaatgatgaaactactgtcgcaggctctgcaaaatgtattgcgcatagagatccatggagtactggatggcatcgcgggcggcgctcgcaggctgcacctcgttgacggcaacttccttgttctcgttcttcttatagtcctcgaagaaccttcggatctcttggacgcgatgaggcgagagctcgttgagatcattgtagtggcggtatcgggatcatcagtgcagacagctatgatcttatcgtccttctctccctggtcaatcataggcatgaggccgatcgctctggcccggaggaagcagccaggaagaactggttcctgcatgagcaccaagacatccatggggtcgttgtcctc

SEQ ID NO: 266 - DNA, 1770 bp, Sorghum bicolor
ctgtcagatgcctctcaacttttaaccatccgcagctcgccgccagtccgcaccacgtcccaacaacttgccaatttgcaccgcgagaaacggcgccgtcctgccgctccgctccgcggctccggccgtgacacgacacgagcgcacacgccctccgccccgtcgcgcgcgccacaggacaaaggcgtccccaaccgccgccccatctcctgtcgtcatctgcctgccgatcgatcgatccctcccctcagctagctagcctcactcaccacccctcccccaacacagtccaagaacccgtatagtccgggcgagctagagctagaggggaccgaaccgggcgggcaggcgagcggaggaggcgaaggaagacatggaccacgcggcggaggcgcagcggacggacctgatgacgatcacgcggcacgtgctgaacgagcagagccgccacccggagtcccgcggcgacttcaccatcctcctctcccacatcgtcctcggctgcaagttcgtcgcctccgccgtcaacaaggccggcctcgccaagctcatcggcctcgctggcgagaccaacgtccagggtgaggagcaaaagaagctggatgtcctgtccaacgaagtctttgtcaaggcgctcgtcagcagcggccgcacctgtgttcttgtgtctgaagagaacgaggaggccatcttcgtcgacccggccctccgcggaaagtactgcgtttgtttcgatccgctggatggctcctccaacatcgactgcggtgtctccatcggaacaatctttgggatttacatgatcaaagataaggacaacgtgactttggaggatgtacttcagcctggaacaaacatgcttgctgctggctattgcatgtatgggagttcctgcacgcttgtgttgagcacgggaaatggagtcaatggtttcactcttgatccttcccttggagagttcattttgacccatccaaatatcaagataccaaagaaagggaagatttattcagtcaacgaagggaatgccaaaaactgggatgggcctacagcaaaatttgtggagaaatgcaaatatcctcaggatggttcatcgcctaaatccttgagatatattggaagtatggttgctgatgtccatcgtaccttactatatgggggcatatttttgtacccagcagaccagaagagtccaaacggaaaactacgtgttctgtatgaagtcttcccgatgtcattcctgatggaacaagctggaggccagtctttcacaggaaaacaacgggcccttgaacttgctcccgctaaacttcacgacagatccccaatattcctcgggagctacgatgacgtggaggagatcaaagcactgtacgcttcagagtcaaacaatgcttgatctttctgtctgaggacactcgcggtcgcagagatcaaagcactgtatgcttcagagtcaactgcttgatctttaaattaaattataataaaaaagttgtaaaaacagcactgcttgatctttctgcccgaggacaagcgcatcagacaagcgcatcatccacattgtaattgtattcatcagatatttattgtgttcttgccatctacgtaaaaatccattctacggccggttacggtacaactgaatagtacaggcttatgtttttttttacaaatttaacatgctttcgtgattccttgatacaaatttggattcatgtataaggaggaactttttatgaagacatattacttgtgcagtttatctca

SEQ ID NO: 267 - DNA, 1423 bp, Glycine max
tttccttctcactcaaagctatgctatgagaataattcatccataacataacagcttggtacccatgtgtcattcctatcatttcgttgacaaaactttcatatccccgaaattctctctttttccactgttccctaggaaatatttattctcatcttcatcctctacacaacacctaagaaggacaagagggaactcataatttataaaaagaacattgagaaagagagaagggaagaagaatggaccaccaagctgacactaacagaactgatttgatgactatcacacgctttgttctgaatgaacagtcaaagtatcccgaatcacgtggcgatttcaccatccttctcagtcacattgttcttggctgcaaattcgtttgttctgctgttaacaaggcgggattggcgaaactcataggacttgctggagagaccaatgttcaaggtgaggagcaaaagaaattggatgtgctttcaaatgaagtatttgtgaaagccttaatcagcagtggacgcacatgccttcttgtttctgaagaggttgaagaggctatatttgtgccatcatcacatcgtggcaaatacattgttgtgtttgaccctctggatggatcctcaaacattgactgcggggtttctattggaactatctttggtatttacatggtgaagaatgaggctgaagtaagtcttgaagatgcattgcaacctgggaaccaaatgttagcagctggttactgcatgtatggaagctcttgcacgttcgtgcttagcacagaaaatggagtgaatggttttacacttgatcctagccttggggagttcatattgactcacccaaacatcaagataccaagtaaaggaaagatttattcggtgaatgaaggaaatgccagaaactgggatgaaccaaccactaaatatgtacaaatgtgcaagtttcctcaggatggttcaccaccaaagtctcttaggtacataggaagtatggttgctgatatccatcgaactttgctttatggtggtatcttcatgtacccagctgatgcaaagagtccaaacggaaagctacggcttctctatgaagtctttccaatgtcatacttgatggagcaagcaggaggtcaggctttcacaggaaaacaacgggctcttgatttgattccaaaaaaaatacatgaacgatcaccagtattccttggcagctacgatgacatcgagcaaatgaaagagctttatgctgcatccaaagaagatgatgcatgaatattgtctttgaatctcagtatatactatttcttgagctcttggctgttaattgggtaggacaacttttgtttaggtggaacattgtgcttatttgaaaatagttatacagaaaagaaaaaggtgaatgggattattttctttaatttaca

SEQ ID NO: 268 - DNA, 1475 bp, Glycine max
caactaagtacgaaaatcgttatccgccgcaacagccactaagatgttctttgagtcttggcacgccacgtgtcagaactgccaacagatagccccatctctttctccttctccctaaacctcgaactcagcacccccatccactggtgattgtttgattgagccttgaagaaatggaccacagcgctgatgcacatcgcacggacttgatgaccataacgcggttcgtgctgaacgagcaatccaagcaccccgagtcacgcggcgatttcaccatcttgctcagtcacattgttctcggttgcaagttcgtttgttccgctgtcagcaaggctggtcttgctaaacttattggactcgctggagaaaccaatgttcagggtgaagaacagaagaaactggatgttctttccaatgaggttttcatcaaggctctcataagcagtggccgaacatgcatcttggtttctgaagaagatgaagaagcgataattgtggagccttctaagcgcggaaagtactgtgtttgctttgacccattggatggctcgtccaacattgattgtggggtttccattggcacaatttttggggtttatgcgttgaaagatgtccatgaaccaaccatagaagatgtcctgcttcctgggaagaacatggtggcagctggttactgtatgtatggaagctcttgcacgcttgtgttaagcactggagctggtgttaatggtttcacccttgacccatctcttggtgagttcatcctaactcaccctgacattaagatcccaaagaaaggtaaaatttattcagtgaatgaaggaaatgccaaaaactgggatggtcctactgctgcttacgttgaaaaatgcaagtttccagaagatggttcatcaccaaagtctctaagatatattggaagcatggtagctgatgttcatcgtacattgctttatggaggcatctttttgtaccctgctgacaaaaaaagtccaaatggaaaacttcgtgtcctgtatgaagtcttcccaatgtcattcttgatggaacaggcaggaggacagtctttcacgggcaaggaacgggcacttgatttagttccaacgaagttgcacgagcgatctcccatattccttggtagctatgatgatgttgaggaaatcaaagctctttatgctgctgctgagggtgaacaagaatgaaattggaaaggtttcttgtatctttcgctacttacaagcgcttgttttctaattgttactagcaggtgcttataagaaaactagttatctggtcatgtatatgttaataaaattggttgatgtgcctgtcagggctatagaatttatttagataaaatacttagattaaagtatcattttgttgctgaagaagtataactgcttactttccctcaagatgcatttcaaagttaaatccgcagacctgttagttactataacgccatttttaca

SEQ ID NO: 269 - DNA, 1315 bp, Glycine max
cataagaccgtgatctttaagcaggacaaaacaaaatctatcaaggaagccatatattggtatccaaattccaaacttgtgttgggtttggttccttgagttgagaggagtgaaaaaatggatcacagtgcggatgctcaacgcacggacctgatgaccatcacccgtttcgtgctgaacgaacagtcgaagcacccagagtctcgtggcgatttctcaatcctgctcagtcacattgttctcggctgcaagttcgtctgctctgctgttaacaaggcgggtcttgctaagcttattggacttgcaggagagacaaatgttcagggtgaagagcaaaagaaattggatgtcctatccaatgatgtcttcatcaaggcattgatcagcagtggacgaacatgcatcttggtgtctgaagaagatgaggaagcaacatttgtggaaccttctaagcgtggaaaatactgtgttgtttttgacccgctggatggttcctctaacattgattgtggtgtttcaattggcacaatctttgggatttatttgataaaagaagaccatgaaccaaccgtagaagatgttttgcaacctgggaagaacatgttggcagctggttattgcatgtatggaagctcttgcacgcttgtgttaagcactggaagtggtgttaatggtttcacccttgatccatctcttggggagttcattctaactcaccctgacatcaaggtcccgaagaaaggcaagatctattcagtgaatgaaggaaatgctaaaaactgggatggtcctactaccaagtatgtggaaaactgcaagtttccaaaagatggttcatcaccaaagtccctaagatatattggaagcatggtagctgatgttcaccgcacatttctttatggaggtatctttctgtacccggctgataaaaagagtccaaatgggaaacttcgtgtactctatgaagtcttcccaatgtcattcttgatggaacaagcaggaggacaggctttcaccggcaaccaaagggcacttgatttggttccaaagaagttgcacgagcgatctcccatattccttggtagctatgaagatgtagaggaaatcaaggctctttactctgctgatgaaaaataggaatgaagctggaagaaagctatctttgtctttcgctactcacaagcaattgttatctaattgttacacatgtcatgtatatgttaagaaaagttattaatgttttgtgatttagaaaaattattttattccttatatctaaatattttaaaatttaataataattataatttatgca

SEQ ID NO: 270 - DNA, 1249 bp, Glycine max
gcgtgaagaaatggatcacagtgccgatgctcaacgcacggacttgatgaccatcacccgcttcgtgctgaaccaacaatccaaccaccctgagtctcgtggcgatttctcaatcttgctcagtcacattgttctcggttgcaagttcctctgctctgctgttaacaaggcgggtcttgctaagcttattggacttgcaggagagacaaatgttcagggcgaagagcaaaagaaactggatgtcctttccaatgatgtctttatcaaggctttggtcagcagtggacgaacatgcatcttggtgtctgaagaagatgaggaagcaacatttgtggaagcttctaagcgtggaaaatactgtgttgtttttgacccgctggatggttcttctaacattgattgtggtgtttcaattggcacaatctttgggatttatttgataaaagaagaccatgaaccaaccattgaagatgttttgcaacccgggaagaacatgttggcagctggttattgtatgtatggaagctcttgcacgcttgtgttaagcactggaagtggtgttaatggtttcacccttgatccatctcttggggaattcattctaactcaccctgacatcaagattccaaagaaaggcaagatctattcagtgaatgaaggaaatgctaaaaactgggatgaccctactaccaagtatgtggagaactgcaagtatccaagagatggttcatcaccaaagtccctaagatatattggaagcatggtagctgatgttcaccgcacattgctttatggaggtatttttctgtatccggctgataaaaagagtccaaatggaaaacttcgtgtactctatgaagtcttcccaatgtcattcttgatggaacaagcaggaggacaggctttcactggcaaccaaagggcacttgatttggttccaaagaagttgcacgagcgatctcccatattccttggtagctatgaggatgtcgaggaaatcaaggctctttacgctgctgaggaatgaagctggaagaaagcattctttgtctttcgctacttacaagcaattgttatctaattgttacacacatacatggtcatgtatatgttaagaaaacttgttaatgttttgtgctttagaaaaattatttcattagttatatctaaatattttaaattttaataacaaataatttatgtagatagttttataatattaattattataatcttattattttattta

SEQ ID NO: 271 - DNA, 1187 bp, Selaginella moellendorffii
tgcttgtttgacgaactcgtgaggttcgtgtagtttttcttttttttcctctcttggttttgggattggaaatttttgggtttttctggattggagcttggaggcatggatcatcaagctgatgcccagcgcaccgatctcatgacaatcactcggttcgtgctcaacgagcagagcaagcatcccgaggctcgcggcgatctcaccattttgctcagtcacattgttctcggatgtaagttcgtgtgctcggcagtgaacaaggctggattggccaagttgattggccttgcaggagaaaccaatgtccagggtgaagaacagaagaagctggatgtgttgtcaaacgatgttttcgtcaaggcgcttagcagcagtggaagaactaatgttcttgtgtccgaggagctggaggaggcgatctttgtggaggcatctcaccgtggcaaatactgtgtggtttttgatcctctggatggctcgtctaacatcgactgtggtgtctcgattggaactattttcgggatttttctactggatcatgacaacgcaggcagcaacgatgatgttctcaagcctgggagtgaaatggtcgcggctgggtattgcatgtacggtagctcatgcacgctcgtgttttctactggatcgggcgtgaatgggtttactctcgatccatccctgggagaatttatattgacacatcctgacattaagataccaaagaagggaaaaatttattccgtgaatgagggcaatgcaaagaactgggacgagcccactagattatatgtggagaatgcaaagttccccaaagatgactcgtcaccaaagtcgctcagatacattggcagtatggtagctgatgtccatcgcacacttttgtacggtggaattttcatgtacccagctgacaaaaagagcccctttggaaaattacgagttctctatgaggtgtttccaatgtcctatctcgttgagcaagccgggggtcaggctttcacagggaaagagcgggcactcgatctagtccccaaacacctccacgagaggtctccaattttcttggggagctacgacgacgtagaggagataaaaaagctgtacagtgcaaccatcgcttaaactattgattcaatctcaagcgaagtcaaaacaataaacctgtggtggaaaaaattctcttc

SEQ ID NO: 272 - DNA, 1807 bp, Picea glauca
attcacttcggtatttaaacaaacaaaccacgggccgggaggaaggctgaatttaattgaatttccttggatttaatttggaggaaagaacatggaccacgcagcagatgcctatcgcacagatctcatgactatcacgcgattcgttctgaacgagcagtctaagtatcctgaatcgcgaggagatttctccattttgctcagtcacattgtcctcggatgcaagtttgtatgctctgccgtcaacaaggcaggtctggctaaactcattggccttgcaggagagaccaacgttcagggcgaagagcaaaagaaattagatgtgctctccaatgaagtatttgtcaaggctcttgtcagcagtgggcgcacgtgcattttagtttcagaagaggacgaggaggccacctttgtggagcattcgaagcggggaaagtattgtgtagtcttcgacccactcgacggctcttccaacatcgattgtggagtgtcaattgggacaatatttggaatatacttggtgaaggatggagcagagccgaccgtgggtgatgttctcaaaccaggcaaaaacatggttgcagcaggttattgcatgtacgggagttcctgcacgcttgtgctgagcagcggcagtggtgtaaatggctttacactggacccttccctgggggaattcattttgactcatcccgacataaggataccaaagaaagggaaaatatattcggtgaacgaaggcaatgcaaagaactgggatgagccaaccaggaagtatgttgagagatgcaaatttccccaggatggatcatctcccaagtctctcagatatatcggaagcatggtagctgatgtgcacagaaccttactgtatggcggtattttcatgtaccctgcggataagaagagtcccaatggaaaattgcgtgttctgtatgaagtgttccccatgtcattcttaatggaacaagcaggaggtcaagctttcacaggaaacataagagcacttgatctggttcccactaagattcaccagcgttcccctgtctttcttgggagttatgatgatgtggaggagattaaggctttgtacgctgcacaggaaggaaaggcgtaaaagtccatccaggattaggcaattgtagttgctcaggattgattcactttttttcaaaaataaaaaatatgaatgcccatttaatgttatttttaagcagacatgaactaagtcaaaccactgaaatctgtactgtcactgatttcttatatttgtaccatgcagtatatgtgtccttggacatggatatatttgatgtgcattacaagtctgtattttaatgaaaaaaattaatgttaatccgtatatgattattttcgatgtccaaaaaaaaaaaaaaaaagaatgaactggatcttgactatgaagaaaagatgtacggctatgtgacgaaagatagctgcggtccagtagggagtggcgatgacgtcgtacacgtaccagtacctcatgcaggcacacccgattacgctagcacaactttcccggacgctctagaggacgaagaggaggtgtttgtgatcgtgttgaggttcttcctcaacgacgtcatcaatgcggtgcagaagctagacgcgagctatcagaagctgactcgtgaagatttcaaattgtgcggagattcgacgatgactatcaacaacgtttgggggaagtacgccctgcagtgctggaactaggcgcgtgacattagactggttgtatctgtagcatcgcatagtcaaaggatacaaaagcatgagtgtacta

SEQ ID NO: 273 - DNA, 1476 bp, Picea glauca
cgaagttgaataaaactacaatcagctcggytttctaaatttacagaggcacacgggctcagaccagatcagctcggctcattccatctcaataatcaaaactgggaagaatggatcacgcggcggaagcccatcgaacagacttgatgactattactcgctttgtgctgaatgaacagtccaagcatccggaagctcgcggggatttcactattctgctgagcaacatagtccttggctgcaaattcgtatgctctgctgtcagcaaggcaggacttgctaaactcattggccttgcaggagagatcaacgtgcagggagaggaacaaaaaaaattagatgtactatcaaatgaagtattcatcaaggctctcataagcagtggacgtacgagcattcttgtttctgaggagaatgagcaggcaacctttgttgagccatcaaaacgaggaaggtactgtgtagtttttgatcctcttgatgggtcctccaacattgattgtggagtatcaattggaacaatatttggaatatacctgcgcaaggatgatagtgaagggacattgaatgatgtgcttcaaccaggaaaaaacatggttgcagcaggatactgtatgtatggaagctcttgcacgcttgtcttgagtactggaactggagtaaatggttttacacttgacccctctcttggggaattcattttgactcatccagacataaaggttccaaagaaaggtaaaatctattctgtgaatgaaggcaatgcaaaaaactgggatgagcctaccaagaagtatgttgagagatgcaagtttcctgaagatggatcatctccaaagtctcttagatatattggaagcatggtagctgatgttcacagaacacttctgtatggtggcatattcatgtaccctgcagataagaagagtcccaatggaaagttacgtactctctatgaagtgtttcccatgtctttcttaatggaacaagcaggaggtcaagcctttacaggcacaggacgagcacttgatatagttccaaccactattcatcagcgttctcctatcttcctcgggagctttgaggaagttgaagagattaaatctttatatgctgctcatgaatcaaagaccttataggttcgttttccacatgtattatacctttttcatgaactggtttaagagtgaagtcgtggggtattgaacactaactattataaactcaagttcctcaagtacaagttctgttaaaagcttgtagaatatgccagctttagacagttaggtaagccattgagagtctccagtctctctaaacattgttcaaattatataatagccctttggttgttggttgcaatgaaaagcatatagagttgtaaaggattgtgtctgacaatattaatggacggtgaattttcatccatgataatagctctgttataaacctctggttctttctcccgagtaggca

SEQ ID NO: 274 - DNA, 1200 bp, Euphorbia esula
catttgtggaaaaatggatcacgaagcagatgcataccgtacggatttaatgacgataacgaggttcgtgttgaacgagcaatcgagacaccctgattcccgtggcgattttactattttgcttagtaatattgttcttggctgcaaattcgtttgcactgctgtcaataaggcaggtcttgccaagcttattggacttgctggggagactaatgttcagggtgaagagcaaaagaaactggatgtgctttcaaatgaagtatttgtcaaggctttagtaagcagcggtcgtacttgcatccttgtctcagaagaagatgaagagccaacctatgtggaggcttcaaagcgcggaaagtattgtgttgtttttgatccactggatggatcctccaacattgactgtggtgtctcaattggaactatctttgggatctacatggtgaaacataccaatgcccctactttagaagatgttttgcaacccgggaaaaatatggtagcagctggatattgtatgtatggtagttcatgcacgcttgtgttgagcaccgggagtggtgtcaatggtttcacccttgatccatcccttggggagttcatacttactcatcctgatgttaagattccaaagaaaggaaagatttattcagtaaacgaaggaaatgcgaagaactgggatggtccaacagccaagtatgtggaaaagtgcaagtatcctacggatggttctccggcaaagtctttgagatacatcggaagtatggttgctgatgttcaccgcacattactctacgggggaatatttttgtaccctgcagataagaagagccccaatggaaaacttcgtgttctatacgaagtgtttccaatgtcattcttgatggagcaagcgggtggtcaggcttttaccggaaagctacgggcacttgatttggaaccggagaagatacacgaaaggtctccgatatttctcggaagctatgacgatgttgaggagatcaaagcattgtatgctgctgaggggtagagtgcataaggaatcatattattcattctcttttagttcctaccttttctgtattctgcctactttctaatcatctctctctttctcaaagttgctttcaataagaattatatgattcttgctactttgttcatatatatctttcaataatgtcaataccatatcatgcc

SEQ ID NO: 275 - DNA, 1283 bp, Fragaria vesca
  misc_feature (816)..(816): n is a, c, g, or t
aacagagcaagctcctcccctgttttgtactgttttgggtggctttcgtttttttttgcttcttcttctgtttgtcaagttttggttttttaaagtgggttttggttttggcgaggaaaggaagaagagagagaggaaaatatggatcatgaagctgatgcttaccgtactgacttgatgaccatgacccggttcgtgctgaacgagcagtccaagcaccctgagtcactaggagacttcaccatcttgctcagtcatattgttcttggctgcaagtttgtgtgctctgctgtcaataaggctggtcttgctaaacttattggccttgctggagagaccaatgttcagggtgaagagcaaaagaaactggatgttctttcaaatgaagtttttgtgaaggctctggtcagcagtggtcgaacttgtatccttgtttctgaggaagatgaagatgccatatttgtggaaccatcaaagcgcggaaagtactgtgttgtatttgatccactggatggttcgtctaacattgattgtggcgtttcaatcggcacgatatttggtatttatgcactatatgatggtggtgaaccaaaactagatgatgtgttgcaaccaggaaagaatatggtggcagcaggctattgcatgtacggaagttcttgcacgtttgtgttaaccactggaagcggagttcatggtttcacccttgatccatctcttggagagttcatactaactcacccaaacatcaagattccgaagaagggaaagagttattctgtgaatgaagggaatgctaagaactgggatggtccnacagccaaatatgtggagaaatgcaaattcccaacagatggttctccaccaaagtctctaagatacattgggagcatggttgctgatgtttatcggacattgctttatggaggtatctttttgtaccctggtgataagaagagtccaaacggaaaactgcgtgttctctacgaagtcttccccatgtcattcttgctggaacaggcgggaggtcaggccttcactggcaaagaacgggcccttgacctcgttccaaagaagatacatgagcggtctccaatattcctcggcagctatgatgatgtggaggagatcaaggcactctatgctgctgaagaaaagaaagaatgaacctacagttctgattcttttatgcgtattacatgacctttcattgttgctctgctacttccacatactttattaatctataaatgggagaatacagtttgttgaaaaaaaaaaaa

SEQ ID NO: 276 - DNA, 1241 bp, Saccharum officinarum
ggcgagatggaccacgcggcggacgcgcaccggacggacctgatgaccatcacgcggcacgtgctgaacgagcagagccggaaccccgagtcccgcggcgacttcaccatcctgctctcccacatcgtcctcggctgcaagttcgtcgcctccgccgtcaacaaggccggactcgcgcagctcattggactcgccggagagaccaacgtgcagggagaggagcagaagaagctggacgtcctgtccaacgaggtgttcgtcaaggccctcgtcagcagcggtcgcacctgcgtccttgtgtccgaggaggacgaggaaacaacgttcgtggaccctaagctacgtgggaagtactgtgtttgctttgatcccctcgacggttcctccaacatcgactgtggcgtctccatcggaacgatctttgggatttacatgatcaaggacaaggacaatgtcactctgtccgacgtactgcaacctggcaaggacatgcttgccgctggatactgcatgtatggcagttcctgcacgcttgttctgagcactggaactggtgtcaatggcttcacacttgatccttcacttggcgagttcatactaactcatccagacatcaagatacctaagaaggggaagatttattcagtcaatgaagggaacgccaaaaattgggacgtgcctgttgcaaagtttgtggagaagtgcaaataccccaaagatggttcgccaccaaaatctttgagatacattggaagtatggttgctgatgtgcaccgtaccttgctatatggaggtgtatttttgtaccctgctgaccagaagagcccaaatggaaagctccgtgtcctttatgaagttttccccatgtcattcctaatggagcaggctggaggtcagtccttcacaggcaaagaacgggctcttgatctggtcccaaccaagatccacgagagatccccgatattcctcggcagctacgacgatgtggaggaaatcaaagcattgtacgccgagcaggcaaagtcaagctcagcttgatcggggaacccaaatgaggttcctggctctgctgtgacctgattcagagtttcagacatttctttccttggtgtcgtcgtaagtttgtaacattcagtgtaatatatagtagggaggcccagaacagcttcacaagcaactaagggcctccgtaaaagttacatactcatatacatgcatgcacatatgcatctctagcacct

SEQ ID NO: 277 - DNA, 1053 bp, Helianthus annuus
  misc_feature (927)..(927): n is a, c, g, or t
ttggcgggggatttaagcaaataaaaaaaatagcaaaatctaaaatcttgtagtgtaatttgtgtgagaaagatggatcatgctgcggatgctatgaagacggatttgatgacgataactcggtttgtgttgaatgagcagtcgaagcatcctgagtcgcgcggtgattttagtattttgcttagtcacattgttcttggttgcaagtttgtttgtgctgctgttaataaggcaggtttagctaaactcattggacttgctggggagaccaatgtgcagggagaagaacaaaagaaactagatgttttgtcaaatgaagtttttgtgaaggcattggtcagcagtggcagaacatgcatacttgtttccgaagaggatgaggaagcgatttttgtagaaccatccaaacgcggaaagtattgcgttgttttcgaccctttggatggatcttccaacattgactgtggtgtttccatagggactatttttggggtctacatgttaaaagacggtgctgagtcgcgcttggaagatgtacttcagcccggaaagaatatgctggctgctggatactgcatgtatggtagctcttgcacgtttgtgttaagcactggatctggtgtgaatggatttactcttgatccatctctaggagagtttatactcacccaccctgacattaagatcccaaagaaaggaaagatttattctgttaatgaaggaaatgctaagaactgggatggtcccactgcaaagtttgtggaaaaatgcaagttcccaaaggatggttcaccagctaaatctctaagatatattggaagtatggttgccgatgttcatcgtaccttactttacgggggtgtgtttttgtaccctgccgataagaaaagcccgaatggaaaactaagggttctctatgaagtcttncctatgtcattcttgatggaacaagcgggaggacagtcgtttaccgggaaagaacgggctcttgatttggtccccaagaagatacatgaaagatctccaatattcttgggaagctatgatgatgtg

SEQ ID NO: 278 - DNA, 1314 bp, Helianthus annuus
gcggggacgatcaattcatctcctcctctaattattataaaaaaaaaaaaaaaatacatacatacatatacatacagttaggttgcttggtttgtttgttattgaacgatggatcacgctgcggatgctatgcatacggatttgatgacgatcacgaggttcgtgttgaacgagcagtcaaagtatccggagtcgcgtggtgatttcagtattttgcttagtcacattgttcttggttgcaagtttgtctgtgctgctgttaataaggcaggtttggcaaaactcattggacttgctggggagaccaatgtgcagggagaagaacagaagaaactggatgttttgtcgaatgaagtttttgtgaaggctttggtcagcagtggcagaacatgcatacttgtttccgaagaggacgaggaagcgataatcgtagaaccatccaagcgcggaaagtattgtgttgttttcgacccgttggatggatcttccaacatcgactgcggtgtttccataggaactatttttgggatttacatgataaaagatgctggtgcggcccgtttagaagatgttcttcagcccggaaagaatatgctggccgctggatactgcatgtacggtagctcttgcacgcttgtgttaagcactggatcgggtgtgaatggatttactcttgatccgtctttaggggagtttatactcacccaccctgacattaagattccaaagaaaggaaagatttattcggttaatgaaggaaatgctaagaactgggatggtcctactgcaaagtttgtcgaaaaatgcaagttcccgaaggatggttcacctgcaaaatctctaagatatattggaagtatggttgccgatgttcatcgtaccttactttacgggggtgtgtttttgtacccggccgataagaaaagcccgaatggaaaactaagggttctctatgaagtcttccctatgtcattcttgatggaacaagctggaggacagtcgtttaccgggaaagaacgggctcttgatttggtccccaagaagatacatgaaagatctccaatattcttgggaagctatgatgatgtggaagaaatcaaggctctgtatgcagctgaagaaaaggcataaataaggttgttcttgtgcatgtgcagttgtatccctctttttctttgttctaaatccagtttttttataacttttttttgttataatttgttgtatttgatatgtgtctatttaattgtcatgtaatattgtgatttttatttttataataatgaaataataaccatcttataaaatattata

SEQ ID NO: 279 - DNA, 1581 bp, Panicum virgatum
ctggctcccagcctcactttccgctcgcccgccgcgccgcgccgcgctaccccatccggcaccggcagaggaaaaccaccgcgcgacacgtcacgccgattccagccacccacccagctcccggccgcgccggccgatataccctgcgccggtaagctcgtgccccgctcgctctgcactgcgcgatcactagctacttcagctagctagctagccagccagccgaacgaagagggagggtgggcgcgcgagcgcggcggcggcggcggcgagatggaccacacggcggacgcgcaccggacggacctgatgaccatcacgcggcacgtgctgaacgagcagagccggaaccccgagtcccgcggcgacttcaccatcctgctctcccacatcgtcctcggctgcaagttcgtcgcctccgccgtcaacaaggccgggctcgcgaagctcatcggactcgccggcgagaccaacgtccagggagaggagcagaagaagctggacgtgctgtccaacgaggtgttcgtcaaggccctcgtcagcagcggccgcacttgcatacttgtgtcggaggaggacgaggaggcaaccttcgtggatcctgcgctgcgtgggaagtactgcgtctgctttgatccgcttgacggctcctccaacatcgactgtggcgtttcaatcggaacgatctttgggatttacatgatcaaggacaaggacaatgtgacgctggaggacgtgctgcagcctggaacgaacatgcttgctgcgggatactgcatgtatggcagttcttgcacgcttgttctgagcactgggagtggtgtcaatggcttcacacttgacccatcacttggcgagttcatactgactcatccagacatcaagatacctaagaagggaaagatttattcagtcaatgaagggaatgccaaaaattgggatgcggctgttgcgaagtttgtggagaagtgtaaataccccaaagatggttcgccacctaaatctttgagatacattggaagtatggttgctgatgttcaccgtaccttgctctatgggggtgtatttttgtaccctgctgacaagaagagcccgaatggaaagctccgtgttctgtacgaagttttccccatgtcattcctcatggagcaggctggaggtcagtccttcacaggcaaagaacgggctcttgatctggtcccaaccaagatccacgagagatccccggtattcctcggcagctacgacgacgtggaagagatcaaagcattgtacgccgaactggcaaagacaagctcggcttgatcagggcatcatacgaggtgtaaatcgacttcctggccttgctgtaacttgattcagacatttcttacctttgtgtcgtcttaagcttgtaagattcagtataatagtatggaggccttgaacatcttcacaagcaactaaaaaggcctccttacaagttacaacatgacgctaatacatacatgtatacatctctagcagctaagtcttgtgttctctggctaagcacactcatagttcattcatttcgacttttcgacaccaagaaaggaatta

SEQ ID NO: 280 - DNA, 1285 bp, Panicum virgatum
gctcccagctagagctaggtagccccggctcccttcccttcccccaccagagctcgctcagaggccattggaggagagcgcgcgtagggggcgagacgacgatggaccacgcggcggaggcgcagcggacggacctgatgacgatcacgcggcacgtgctcaacgagcagggccgccacccggagtcccgcggcgacttcaccatcctcctctcccacatcgtcctcggctgcaaattcgtcgcctccgccgtcaacaaggccgggctcgccaagctcgtcggcctcgccggggagascrrctscagggtgaggagcagaagaagctggatgtrctgtccaacgaggtctttgtcaaggygctcgtcagcagcggccgcacctgcgttcttgtgtctgaagagaacgaggaggccattttcgtcgacccgcaactccgtgggaagtactgcgtttgtttcgatccgctggatggctcctcaaacatcgactgtggtgtctccatcggaacaatcttcgggatttacatgatcaaagataaggataatgtgactttgggtgatgttctgcaacctggaacaaacatgcttgctgctggctactgcatgtacgggagttcctgcacgcttgtgttgagcacggggaatggagtcaatggtttcactcttgatccttcccttggggagttcattttgactcatccgaacatcaagatacccaagaaagggaagatctattctgtcaatgaagggaatgccaaaaactgggatgtacctacagcaaagtatgtggagaaatgcaagtttccccaggatggttcatcgcctaaatcattgagatatattggaagcatggttgctgatgtccaccgtaccttgctatatggaggcatatttttgtacccagcggaccaaaagagtccaaacggaaaactccgtgttctgtatgaagtcttcccaatgtcattccttatggaacaagctggaggtcaggctttcacaggaaaacagcgggcccttgaacttgctcctactaagcttcatgacagatccccaatattcctggggagctatgatgaggttgaggagatcaaagcattgtacgcttcagaatcaagcgccgtttgatctgtctgcctgaatgcatcattctcctgggagaaaattgtaactgtattgatcagttatttatgttctgttcttgccttcttggccttataatgtaaaatattcactatacggacacagtacaagtcaataagcaaccgaggcttatgtttcacacac

SEQ ID NO: 281 - DNA, 1458 bp, Solanum lycopersicum
gtttgattggagaaacttttaatactattatttataaacattttaaaaagatatttacttatttagtttaattttttatttttttaacaaatgatgtcaaactcgaatctgtcaactaaataggagcctcgaattgcgggctactggtgtaaacatgaaattgcgtgccacccaattttttccccaattttataatttgatgtataactgttattgaagagttttggagaagaaagcagagcgatggatcacgcagcagatgctcatcggactgatttaatgactattactaggttcgtgttgaatgaacagagtaaataccctgaatctcgcggcgatttcactattttgctcagtcatattgttcttggctgcaaatttgtttgtactgcagttaacaaggcaggtttggccaaactccttgggcttgctggtgagactaatgtgcagggtgaagaccaaaagaaactggatgtactctcaaatgaagttttcatcaaagctttggtcagcagtggtcgaacatgcattctcgtgtctgaagaagacgaagaagctactttcgtagagccatctaagcgtggaaagtactgtgtggtttttgatcctctggatggatcttccaacattgattgtggtgtttctattggaacgatctttgggatttacatgatgaaagatgttcatgaaccaacactagatgatgtcttgcaacctggaaagaatatgttagctgctggatactgcatgtatggaagttcttgtacgcttgtcttgagcactggaaaaggtgttaatggttttacacttgacccctctttaggcgagttcatcttaactcatccagatatcaagattccgaagaaaggaaagatttattcagtgaatgaaggaaatgccaagaactgggatggtccaacatctaaatacgtggagagctgcaagttccccacggatggttcttcacccaaatctttaagatatatcggaagcatggtagctgatgttcatcgtacattactctacggaggtatctttttgtacccagctgataagaaaagccccaatgggaagctacgggttctctatgaagtatttcccatgtcatttctgatggaacaagcaggaggtcaagcatttactggaaaggagcgggcactggacttagttcctacgaagatacacgaaagggcgccaatattccttggtagttacgatgatgtggaggagatcaaaaggctttatgctgctgaagagaaaaactaatgaatgtacatttacattcattatcttattttacaattcttgttgatgcttattgctaatttgttgaaatatagcaaatttgctggttgttataagtcacaaaatcataaaattatgactacaaatgtatgttccacattagcttgttggctactgtgataataatacctgcatataaatgagcaatcttta

SEQ ID NO: 282 - DNA, 1636 bp, Solanum lycopersicum
agaaaaacaaattagttacagaaatgacgaattggatcacgctttaycttagtgcgaaccactgatcccatgcatcactctcctctttccacgtgtcatcctctgacgtcagaccagattcctcttctcttttttttttttaaatatatatgagcattttagcaagtactgcgtgcccaatctcttgcacaaaaatcgaaagcacgatggatcacgcggcggatgctcaccggacggatttgatgacgataacaaggtttgtgttgaatgaacagacgaagcaccctgaatcccgtggagacttcagtattttgctcagtcacattgttcttggctgcaagttcgtatgcactgctgttaacaaggcaggtttggctaaactcctaggacttgctggtgagactaatgtgcagggagaagatcaaaagaaacttgatgtactctcaaatgaagtgtttatcaaggctttggttagcagtggccgaacatgcattcttgtctctgaagaagatgaagaggccacatttgtggagccagctaaccgtggaaaatactgtgtagtttttgatcctctggatggatcatcgaacatcgattgtggtgtttctattggaacgatctttgggatttacatgatcaaagacggtcatgaaccaacactagatgatgtcttgcaacctgggatgaacatgttagctgctggttactgcatgtatggaagttcttgtacgctagttttgagcactggatctggagttaatggttttacccttgatccctctcttggcgagttcatcctaactcatgctgacatcaagattcctaagaaagggaagatttattcagtgaatgaaggaaatgccaagaactgggatggtccaacatccaaatatgtgcagaactgcaagtatcccgctgatggttcttcacctaaatctttgagatatattggaagtatggttgctgatgttcatcgtacattactctatggaggcatcttcttgtaccccggagataagaaaagccccaacgggaagctgagggttctctatgaagtatttcccatgtcatttctgatggaacaagcaggaggtcaagcatttactgggaagcaacgggcacttgacttagttccagagaagatacacgaacgctctcctatatttcttggtagttatgatgacgttgaggagatcaagaatctctacgctgctgaagagcaaaactgatagatgtatctataccatgtaatcacttcactactcttgctggtgcagatatcaaatttctcaaattagagcaagttgttactgtttatgttgcacaatagctgctgtgacgcgataatacgttcacattactggcttgttctaacttttttcttgaagtatccttttctcatcaacaataaaatgttgaatagagaagttctggcttattattgctcattttaattcaaagttcttttgtaatgtcatccatttagaatcaagccaatcttttctgctagatgttgtctggttctcattgcattgttatctttcataggttgttgactaacatctatataaatgatatcactggcttcttgtgaaattcttgataatggaattcaaagattgccgatataattttt

SEQ ID NO: 283 - DNA, 1296 bp, Triphysaria pusilla
acagataacatttctatactatatatacatggacacgcataaataaagtttcttggagttatcataataattatagtggagtgcgcagtcaaaaagatatagtattttgtagttacacatttttcgcaaaggtttttggggcgatggatcacgcggcggatgcttaccggaccgatttgrtgacgataacmcgtcatgtgttgaacgagcagtcaaagcacccggagtcgcgtggggatttcacgattttgctcagtcatattgttcttggctgcaaattcgtttgctctgctgttagcaaggccggttyggctaaacttatyggactagccggagaaactaatgtgcagggtgaagaacaaaagaaattagacgtgctctcgaacgaagttttcatcaaggcgttagttagtagtggacgaacttgtatccttgtctctgaagaagatgaagaggcaacattcgtggagccctctcaccgtggaaagtattgtgttgtgtttgacccgttggatggatcttccarcattgattgtggtgtttcaattggaactatatttggtatttatgctatttacgatgggcatgacccgaaactggaagacgtgttacagcctgggaagaacatgttagccgcaggctattgcatgtatggaagctcgtgcacgtttgtgttgagtactggatcgggagttaatgggttcacactcgatccatctcttggtgaattcattttgactcatcctgatattaagattccgaaaaaaggcaaaatttattctgttaacgaaggaaatgccaagaactgggatggccctactgcaaagtatgtggagaaatgcaagtaccccacagacgggtcacctgcaaaatccctgagatacatcggaagtatggtagccgatgtccatcgcacgttgctctatggaggcgtatttttgtacccagccgataagaaaagcccaaatggaaaactgagggtcctatacgaagtttttcccatgtcgtttttgatggaacaagcaggaggacaagcatttacagggaaggagcgggcacttgatttgcttcctcagaagatacacgaccgctcaccgatattccttggtagctatgacgatattgaggagatcaaagcattatatgctgctgaggagcaaaaataatggacttgtaaatttcttttacggactttcgattttttactcattgttaattactctttcatgtaataaaaacacaattattcttttggaatatatagtttcggttctgaygaaaggccgatgtgaatca

SEQ ID NO: 284 - DNA, 1246 bp, Triphysaria pusilla
aaagggttttggggcgatggatcacgcggcggatgctcaccggacggacttgatgacgataacgcgccacgtgttgaacgagcagtcaaagcacccagagtcgcgtggggatttcaccattttgctcagtcatattgttcttggctgcaagttcgtttgttctgctgttaacaaggccggtttggctaaacttatcggacttgccggagagacaaatgtgcagggtgaagagcagaagaaattagatgtgctgtcgaacgaagttttcatcaaggcattagtcagtagcggccgtacgtgtattcttgtctcggaagaagacgaagaggctacattcgtggaaccctctcaccgtggaaagtattgtgttgtgttcgacccgttggatggatcttccaacatcgactgtggtgtttcaattggaactatatttggtatttatgcgatttatgatgggcacgacccgaaactggaagacgtgttgcagcctggaaagaacatgttagccgcaggctattgcatgtacggaagctcgtgcacgttcgttttgagtactggatcgggagttaacgggttcacactcgacccatctcttggagaattcatattgactcatccggatattaagattccgaaaaaaggcaaaatttattctgttaatgaaggaaatgccaagaactgggatggcccaactgcaaagtatgtggagaaatgcaagtatccgacagatgggtcaccggcaaaatctctgagatacatcggaagtatggtagccgatgtgcatcgcacgttgctttatggaggcgtgtttttgtacccagctgataagaaaagcccgaacggaaaactgagggttctttatgaagttttcccgatgtcgtttttgatggaacaagcaggaggacaagcgtttactgggaaagagcgggcacttgatttggttcctaagaatatacacgaccgctcaccgatattccttggtagctatgacgatgtcgaggagatcaagatactatatgctgctgaggagcagaaataatggacttgtcaatttctttcgagtttcgattttaataaaaacataaacattcttttagaatatatagtttcgtttctgatgaaaggccgatggtatgtgcctatccgagattgtggtttaacaaatgcatcttatgaaaataaaatgtaaataatcgaagttatggggtcgttatagaatttctgagaaaaaaaattctttagaaca

SEQ ID NO: 285 - DNA, 1338 bp, Triticum aestivum
tgcgctgcaagcaaagcccgcaacacgtaccaactctcctacgagctgagcgagcgaacgggagagagggtcggcgtcggagaaggaagatggatcacgcggcggacacgttccggacggacctgatgaccatcacgcggcacgtgctgaacgagcagagccggcacccggagtcgcgcggcgacctcaccatcctcctctcccacatcgtcctcggctgcaagttcgtcgcctccgccgtcaacaaggccggcctcgccaagctcaccggcctcgccggcgagaccaacgtccagggggaggagcagaagaagctggacgtgctctccaacgaggtgttcgtcaatgccctcgtcagcagcggccgcacctgcgttcttgtgtccgaggaggacgagaaggcgacgttcgtggaccctaagctccgtggaaagtactgtgtctgctttgaccccctggatggatcctccaacatcgactgcggcgtctccatcggaacgatctttgggatctacatgatcaagaaccaagacaccgtgactctggaggaagtactgcagcctgggaaggacatgattgctgccggatactgcatgtatgggagttcctgcacgcttgtcctgagcactggaaatggtgtcaacggcttcacgcttgacccctctctcggggagttcataatgactcatccagatatcaagataccgccgaaaggaaagatctattcggttaatgaagggaacgccaagaactgggacacgcctactgcaaagtacgtggagaagtgcaagtaccccacggatggttcatcacctaaatcccttagatacatcggcagcatggttgctgatgtgcaccgcaccttgctatacggcggcatatttctgtaccccgcggacaagaagagcccaagcggaaagctccgtgtgatgtatgaggtgttccccatgtcattcctgatggaggaggctggaggccagtctttcacaggcaaaggacggtcgctcgacctgatccccaccgacatccacgagagatcgccgatattcctcggcagcagcgacgacgtggaggagatcaaggcactgtacgcggaggaggccaagaaggcagggtctgcatgatgatcggcggccgtcgcgtgtgaatcgatggcgacccatgggcctttgctggcaatgtgattcgtatgtcaggcatttcttttctatacgtccgtgtcattcagtgtaatatagcgtgtggaggcctcgaacagcttcattcatgagcagccaaggcttctgcctctcacaacaatccactgatgatggcacgtaatatacctccataactaca

SEQ ID NO: 286 - DNA, 1350 bp, Triticum aestivum
gcgctgcaagcaaagcgagctctccgtccgagctaagcgaacgagagggagggtagggtcgtccccggccggccggagaagatggatcacgcggcggacactttccggacggacctgatgaccatcacgcggcacgtgctgaacgagcagagccggcacccggagtcgcgcggcgacctcaccatcctcctctcccacatcgtcctcggctgcaagttcgtcgcctccgccgtcaacaaggccggcctcgccaagctcaccggcctcgccggcgagaccaacgtccagggggaggagcagaagaagctggacgtgctgtccaacgaggtgttcgtcaatgccctcgtcagcagcggccgcacctgcgttcttgtgtccgaggaggacgagaaggcgacgttcgtcgaccctaagctccgtggaaagtactgtgtctgctttgatcccctggatggatcctccaacatcgactgcggcgtctccatcggaacgatctttgggatctacatgatcaagaaccaagacaccgtgactctggaggaagtactgcagcctgggaaggacatgattgctgctggatactgcatgtatgggagttcctgcacgcttgtcctgagcactggaaatggtgtcaacggcttcacgcttgacccttctcttggggagttcataatgactcatccagacatcaagataccgccgaaaggaaagatctattcggttaacgaagggaatgccaagaactgggacacccctactgcaaagtacgtggagaagtgcaagtatcccacggatggttcatcacccaaatcattgagatacattggcagcatggttgctgatgtccaccgcaccttgctatacggcggcatatttctgtaccccgcggacaagaagagcccgagcggaaagctccgtgtgatgtatgaggtgttccccatgtcattcctgatggaggaggctggaggccagtctttcacaggcaaaggacggtcgctcgacctgatccccaccgacatccacgagagatccccgatattcctcggcagcagcgacgacgtggaggagatcaaggcgctgtacgcggaggaggccaagaaggcaggatctgcatgatgatcggcggccatcgcgcgcaaggcgtgtgaatcgatggcgactcgtgggccttgctgacgatgcgattcgtatgtcaggcattccttttctatatatacgtctgtggcactcagtgtaatatagcgtgtggaggcctcgaacagcttcattcatgagcagccaaggcttctgcctctcacaacaatccactgatgatggcacgtaatatatcataactacatgtatccagct

SEQ ID NO: 287 - DNA, 1362 bp, Triticum aestivum
cgtccgagctaagcgaacgagagggagggtagggtcgtccccggccgatcggagaagatggatcacgcggcggacacgttccggacggacctgatgaccatcacgcggcacgtgctgaacgagcagagcaggcacccagagtcgcgcggcgacctcaccatcctcctctcccacatcgtcctcggctgcaagttcgtcgcctccgccgtcaacaaggccggcctcgccaagctcaccggtctcgccggcgagaccaacgtccagggggaggagcagaagaagctggacgtgctctccaacgaggtgttcgtcaatgccctcgtcagcagcggccgcacctgtgttcttgtgtccgaggaggacgagaaggcgacgttcgtggaccctaagctccgtgggaagtactgtgtctgctttgaccccctggatggctcctccaacatcgactgcggcgtctccatcggaacgatctttgggatctacatgatcaagaaccaagacaccgtgactctggaggaagtactgcagcctgggaaggacatgattgctgctggatactgcatgtatgggagttcctgcacgcttgtcctgagcactggaaatggtgtcaacggcttcacgcttgacccttctcttggggagttcataatgactcatccagacatcaagataccgccgaaaggaaagatctattcggttaacgaagggaatgccaagaactgggacacccctactgcaaagtacgtggagaagtgcaagtatcccacggatggttcatcacccaaatccttgagatacattggcagcatggttgccgatgtccaccgcaccttgctatacggcggcatattcctgtaccccgcggacaagaagagcccgagcggaaagctccgtgtgatgtatgaggtgttccccatgtcattcctgatggaggaggctggaggccagtctttcacaggcaaaggacggtcgcttgacctgatccccaccgacatccacgagagatccccgatattcctgggcagcagcgacgacgtggaggagatcaaggcgctgtacgcggaggaagccaagaaggaaggatctgcatgatggtcgaccggtcgtcgcgcgcaaggcgtgtgaatcgatgacgactcgtgggccttgctgacaatgtgattcgaatgtcaggcatttcttttctatatatacgtctgtgtcattcagtgtaatatagcgtggaggccttgaacagcttcactcgtgagcagccaaggcttctgcttctttccacaattcgttcactgatgatacgtaatatacatccatgtatacatatatccatctcaggaggaccagtgccgcaagctgtgcggaatg

SEQ ID NO: 288 - DNA, 6297 bp, Ricinus communis
atggaggatccagacgggacattagcaagtgttgcgcaatgcattgaacagttgcggcagagttcatcatctttacaagagaaagagcattccttgaggcagttgctagaacttattgaaacaagggaaaatgctttcagtgctgttggatctcattctcaagcagttccagtgcttgtttctcttctccgatcaggatcgcttggagtgaagatacaggctgctactgttttaggctctctctgtaaggagaatgagttaagggtaaaagtcttgctcggaggatgcattccaccgttacttggtctcctcaagtcaagttctgcagatggtcaaattgcagcagcaaagacaatatatgctgtttctcaaggaggtgctagagatcatgttgggtcgaaaatcttttcaactgaaggagttgtcccagtgctatgggagctgctaaaaaatgggctcaagactggcaatttggttgataacttattgactggagcactaaaaaatctctctagtagcactgagggattttggtctgcaacaatacaagctggaggagtggatatacttgtgaagttgctcacaactggacagtctggcactcaggctaatgtctgctttcttcttgcatgtatgatgatggaggatgcgtctatttgttctaaggtattggctgcagaggctactaaacaactgcttaagcttataggaactggtaatgatgcccctgtcagagcagaagcagcaggtgctcttaagtctctttctgcacagtgtaaagaagcaagacgggagatagctaatcacaatggtattcctgtattgataaatgctacaatagctccttcaaaggagtttatgcagggtgagcatgcccaagcattgcaggagcatgctatgtgtgcactcgcaaacatttctggtggattatcatatgtaatctcgagccttggtcaaagccttgaatcatgctcttcacctgcccaaactgctgacacattaggggcacttgcttcagctctgatgatctatgatagccaagctgaatctactagggcatcagatcccatgtctattgagcagactctggttcagcagttcaagcctcgcctaccctttcttgtacaggagcgtaccattgaagcattagctagtttatatgggaatgccatactttcaattaaactagcaaattctgaagcaaaacgattgcttgtaggtttgatcacaatggcaaccaatgaagttcaggatgagcttgtaagagctcttcttacactctgcaacaacgagggcagcctgtggcgtgcactccaaggccgcgaaggggttcaactattgatatctcttcttgggctttcatcagaacaacagcaagaatgtgcagttgcattgctttgccttctatctaatgaaaatgatgaaagtaagtgggcaatcactgctgctggtggtattcctccacttgttcaaattcttgagactgggtctgctaaagccaaggaagattctgccacaatccttaggaacctatgcaatcacagtgaagatatacgtgcatgcgttgaaagtgctgatgctgtccctgcattattatggctacttaagaatgggagtccaaatgggaaagaaattgccgcaaagactttaaatcatttaattcataaatctgatacagcaaccatcagtcagctcactgctttgttaaccagtgatctgcctgaatccaaagtgtatgttttggatgctctaagaagtatgctttgtatggtttccttgaatgatatattacgggaaggtagtgcttcaaatgatgctatcgagacaatgataaagatattgagctctactaaagaagagacacaggccaaatctgcctcagctttggctggaatttttgaagtcaggaaggacttgcgtgaaagtagtattgctgttaaaactctttggtcagtgatgaaattgctaaatgttgaatctgaaaacatcttagtagaatcatctcgttgccttgcttccatatttctttctattaaagagaatcgagatgttgctgctgttgctcaagatgcattgtctcccttagtgacacttgctaactcttcagctttggaagttgcagagcaggcaacatgtgctttggcgaatcttattttggatactgaagcttcagagacagcaactcctgaagaaattattttgcctgcaactagggttttgcatgagggcacagtttctggaaagacccatgcagcagcagcaattgctcatctgctccattctcgaagaattgattatgctgtaactgattgtgtcaatcgtgctggaacagtccttgcattagtttcatttttagattcagctaatgggaaatctattgccacatcagaggcactagatgcacttgctattctgtcaaggtcaggaggggccagtgaacatatcaaacctacatgggcagttctagcagaatttccaaaaagtataaccccaatcgtttcatctattgcagatgcaacacccttgttgcaggataaagctattgaaattttgtcccgactttgccgagatcagcctgttgttttaggaaaagcagttgttagtgcctctggttgtataccttcagttgctagaagagtgatcagttctgcaaacccaaaggtcaaaattgggggagttgcagttcttatttgtgctgcaaaagttagtcatgagagagtggtggaagatcttaatcaatcaaattcctgtacccatcttattcaatcacttgttgcaatgcttaattctgcagagacttctttgggaaccgaaggtgatgtaaaggaagccatcagcatctgcaggcatactccagaagaatctgggaatggtgattcaaatgcagaaacagcattagtctatggttataacttagctatatggctactctctgttcttgcctgtcatgatgggaaaagtaaaacggtgataatggacgctggagcggttgaggtcctcacagacagaatctcacattgttatatgcaatatagtcagagtgaatttattgaagatagcagcatatggatttgtgctttattgctagcaattctgtttcaagatagagatatcatacgagcacatgcaaccatgaaatccataccagtgctcgcgaatttgttgaagtcagaggactccgcaaacagatattttgctgctcaagcaattgcaagtcttgtgtgtaatggtagtagggggactcttctgtctgttgccaattcaggggcggcaggtggtctaatttctttacttggctgcgctgatgttgatatagctgaccttctggaactatcggaggagtttgctttggtgcgttatccagaccaggttacccttgagaggttgttcagagttgaagacataagggttggagctacttctcgaaaagcaatacctgcgcttgttgatctactcaagccaattccagatcgacctggggcaccttttctagcactagggcttctgactcagcttgctaaagactgtccaccaaataagattgtaatggtagaatcaggtgctctggaagcgctgactaagtatctttcactcggtccccaagatgcaactgaagaagctgcaactgacctattagggatcctatttagcagtgctgaaattaggagacatgaatctgcatttggtgctgtcagtcaacttgtagcagtattacgtttgggtggaagaggtgcaaggtacagtgctgctaaagcattggaaagcctattttctgctgaccatattagaaatgctgagacttctcggcaagctgtccaaccattggtggagatcctgaatactggtatggagaaagaacagcatgctgcaattgctgcattggtcaggttattgagtgaaaacccatcacgagccctggcagttgctgatgttgagatgaatgcagttgatgtcctttgccggatcctctcttcaaattgctcaatggagctgaaaggggatgctgcagagttatgtggtgtcctttttggaaatacacgaatcaggtccacaatggctgcagcacgctgtgttgagcctctggtttctctccttgttactgagttcagtcctgcgcaacattcagttgtccgtgctctggacaaacttgttgatgatgagcaactggcagaattagttgctgcacatggtgcagttattcctcttgttggccttctctatggtagaaattatatgcttcatgaggctatttccagagcactagtgaagctggggaaagacagacctgcttgtaaactggaaatggtaaaagctggagtaattgaaagcatacttgatattttctatgaagcaccagattttctctgtgcttcatttgcagagttgctccgaatattaactaataatgctagcattgctaagggagcatcagctgcaaaagtggttgagccccttttcctgctgctaacaagacctgaatttgggcctgatggacagcatagtgcattacaggttctagtgaacattctggagcatccacaatgtcgtgctgattataacctaacctctcaccaagctattgaaccacttatccccttgcttgattctgcagccccagcagttcagcagttggcagctgagcttctatctcatctcctcctggaagaacatcttcagaaggatccagtgacacagcaaataattggtcccctcataagagttcttggttctggcatacatatcttgcagcagagagctgtcaaggctcttgttagcattgcactaatgtggccaaatgaaattgcaaaagaaggaggtgtcactgagctgtccagggtgatattgcaagctgatccttctcttcctcatgccttgtgggaatctgctgcttctgtattagctagcattctgcaatttagttctgagttttatttggaagtgcctgttgctgtgttggtgaggctgctccgttctggctcagaaagcacagtagttggtgccctgaatgcccttttggtgttagaaagtgatgatggaactagcgctgaagcaatggctgaaagtggtgccatagaagctcttttggaacttcttagatgccatcagtgtgaggaaacagctgcaaggctgctggaagtcttactcaacaatgtgaaaatcagagaatcaaaagctacaaaagctgcaatcttgccgttgtctcagtacctcttggatccacaaactcaagcgcagcaggcaaggctactggcaactttggctcttggagatctattccagaatgagggtttggctcgaagtaccgatgcagtttcagcttgtcgtgctctagtcaatgtgctcgaagagcagcctacagaagaaatgaaagttgtggctatatgtgctttgcagaaccttgttatgtacagccgatctaacaaaagagcagttgcagaggctggtggtgttcaggttgtattggatctgattggttcgagcgatccagatacatctgtccaggctgcaatgtttgtcaaacttctcttctccaatcacaccattcaggaatatgcttctagtgaaacagtcagagctattactgctgctgttgaaaaggatttatgggccactggaactgtgaatgaggagtatctaaaagctcttaattccctcttcagcaacttcccacgccttagagcaactgagcctgcaacactcagtatacctcatttggttacatccctcaagactggctcagaagcaacacaagaagctgccttggaagcactttttcttctaaggcaagcttggtccgcgtgtccagctgaagtttcaagggctcaatccattgctgctgcagatgctatcccattgttacaatacttgattcagtctggcccaccccgattccaggagaaggctgaatttctgttgcagtgtttgcctggaacattggtggttatcatcaagcgtggaaacaacatgaagcagtcggtagggaatccaagtgtatattgcaaacttacacttggcaatactccaccaagacaaacaaaggttgtatcaactggacctaatccagaatgggatgagagctttgcatggtcctttgagagtcctccaaaaggccagaagcttcacatctcttgcaaaaataagagcaagatggggaagagctctttcggaaaagtaacaatccagattgatcgggttgtaatgctgggagcagttgctggggagtacacactgttgccagagagcaaaactgggccctcaagaattttggaaatagagttccagtggtctaacaagtga

SEQ ID NO: 289 - DNA, 6792 bp, Populus trichocarpa
atggcggctacacttgcttggaggttatctgctaccaatggcagcagcctggccactgctgatctggaaaaaaatggcgatctaaaaattcaagattcagagccaccaactccccattcagttatgaagatgggtgtaagagaccgtactagtagcatggaggatccagatggcacactagcaagtgtagcacaatgcattgagctgctacgtcagagttcctcatctgtacaagagaaagagtatgcattgagacagttgcgagaacttgttgagacacgtgaaaatgcattcagtgctgtgggatctcactctcaagcagttccagtgcttgtttctcttctccggtcaggatcactgggagtgaagatacaggctgctactgtcctaggttctctctgcaaggagaatgaactaagggtaaaagtcttacttggaggatgcatcccaccattgcttggtctcctcaagtccagctccgcagaagggcaaattgcagcggcaaagacaatatatgccgtttcccagggtggtgctaaggatcatgttggctcaaaaattttttcaactgaaggagttgtgcctgcactctgggagttgcttcgaaacgggctcaagacgggcaacttagttgataacttgttgactggagctttaaaaaacctctccagcagcactgagggattttggtctgcaacaatacaagctggaggagtggatatactagtgaagttgctcacaacaggacagtcagacacacaagcaaatgtgtgctttcttcttgcatgcatgatgatgcaagatgcatctatttgtttcaaggtattggctgcagaggctactaaacagctgctcaagctgttaggacctggcaatgaagcctctgttagagcagaagctgctggtgcccttaagtctctttctgcacagtgcaaagatgcaagacaagagatagctaaatctaatggcattcctgctctgataaacgcgacaatagctccttcaaaagaattcatgcagggggagtatgcccaagcattacaggaaaatgcaatgtgtgctcttgcaaatatttctggtggcttgtcatttgtcatctcaagccttggtcaaagccttgaatcatgctcttcacctgcccaggctgctgacactttaggagctttggcttcagctctgatgatatatgatagtaaagctgaatccactagggcatcagatcctgtggctattgaacagactttagttaatcagttcaagcctcgtttaccatttcttgtgcaagaacgtaccatagaagcattagctagtttgtatgggaatgccatcctctcagttaaacttgtgaattctgaagcaaaacggttgcttgttggtttgattacgatggctatcaatgaagttcaggatgagcttgtaagagctcttctcacactttgcaataatgaaggcagtctatggcgtgcgcttcaaggacgtgaaggggtccagctattgatatctcttcttggcctttcatcggaacagcagcaggaatgtgcagtggcattgctttgccttctatctaatgaaaacgacgaaagcaagtgggccatcactgctgctggtggtatacctccccttgtccaaattctagagacaggatctgcaaaagccaaggaagattctgctacaatccttaggaacttatgcaatcacagtgaagatatacgtgcatgtgttgaaagtgctgatgctgttcctgcattattatggctactgaagaatgggagtcccaatgggaaagaaattgcagcaaagactttaaatcatttgatccataaatccgatacagcaactattagtcagctcactgcattgttaaccagtgatctacctgaatcaaaagtgtatgtcctggatgctctaagaagtatgctttctgtggttcccttgagtgatgtactacgggatggcagtgctgcaaatgacgcgattgagacaatgattaagatattgagctctactaaagaagagactcaggccaagtctgcctctgctttggctggaatttttgaaaccagaaaggatttacgtgaaagcagcattgagaaccgggaagtggctgctgttgctcgtgatgcgttatcccctttaattgcactagctaactcatcgactttggaagttgctgaacaggcgacatgtgctcttgcaaatcttattttggatggtgaagtttcaaaaaaagcaattccaaatgaaattattgtgccagcgactagggttttgcgtgaaggcacaatttctgggaagacccatgcagcagcagcaattgctcgtctccttcattctcgtagaattgataattccataactgattgtgtcaatcgtgcaggaacagtacttgcattagtttcttttctagaatctgcaagtggtggatctgctgccacatcagaggccctggctgcacttgctattctgtcaaggtcagaagggactagcggacacatcaaaccagcatgggcagttttagctgaatttccaaaacgcataaccccaatagttttgtcgattgcagatgcaacacccttgttgcaggataaggctattgaaatattatcgagactttgccgagatcagccttttgttttaggagaggcagttgcttgtgcctctggatgtataccttcagtggctagaagggtgatcaattccacgaacccaaaggtcaaaattggaggagctgcacttcttatttgtgctgcgaaagttagtcatcaaagagtggtggaagatcttaaccaatcgaattcatgtagtcatcttattcaatcacttgtcacaatgctttgttctgcagatgcttctccttcagaagacctggttgatgatgacaaggaggtcattagcatccacagatatgctaaagaaggtgagaatggtgaatctcataaaggaacagcagtaatttatggttataacttagctgtttggctactttcggttcttgcctgccatgatgagaaaagtaaaattgttataatggaggccggagcagttgaagtcctcaccaacagaatctccagttgtatttcgcactacagtcagagtgattttagtgaagacagcagcatatggatttgtgctctactgctagctattctgtttcaagatagagacatcatacgtgcacatgcaaccatgaaatctataccagtacttgcaagtatgttgaagtcagaggaatctgcaaacagatattttgctgcacaggcaatagccagcctagtgtgtaatggtagtaggggaactcttctgtctgttgcaaattctggggcagcaggtggtcttatctccttacttggctgtgctgatggtgatatatctgatcttctggaattgtctgaagtgtttgctttagtgcgttatccggaccaagttgccctagagaggttattcagagttgaagacattagagttggtgctacatctcgcaaagcaatacctgctcttgttgatctactcaaaccaattccagatcgtcctggggcaccttttctatcattaggacttctaaatcagcttgcaaaagactgtccaccaaataagactgttatggttgaatcaggggttttggaggccctgactaagtatctttcacttggtccacaagatgcaaccgaggaagctgcaactgatctgttagggatcctatttaatagtgctgagattcggagacatgaagctgcttttggtgctgtcagtcaacttgttgctgtcctgcgcctgggtggaagagctgcaaggtacagtgctgctaaagcattggaaagcttgttttctgctgatcacatcaggaatgcagacactgcccgacaagctgtccaacccttggtggaaattcttaatactggtctagagaaagagcagcatgctgctatagctgcattggttaggttattgagtgaaaacccatcaagagcccttgcagttgctgatgttgaaatgaatgcagtggatgtactttgcaggatcctctcgtcaaattgctcaatggagctgaagggcgatgctgcagagttgtgcggtgttttgtttggaaatacaagaatcaggtctacaatggctgcagctcgctgtgttgagcctttggtctctctccttgtaactgagttcagtcctgctcagtattcagttgtctgtgcattggaaaaacttgttgatgatgaacaactggcagaactagttgctgcacatggagcagttattcctcttgttggccttctctatggtaggaactacatgcttcatgaggctatctccagagcacttgtgaagttggggaaagacaggcccgcttgtaaaatggaaatggtaaaagctggagtaattgaaagcatacttgatatcctccatgaagcaccagattttctcggtgcagcatttgcagaattgctcagaatattgaccaacaatgctagcattgccaaggggccttctgctgcaaaagtggttgagccccttttcctgcagctgacgagaccagaatttgggcctgatggacaacatagtgctttacaggttctagttaatattctggaacatccacagtgccgtgcagattataccctcacctctcaccaaactattgagccacttatccccttgcttgattctccagctccggcagtgcaacagctggctgctgagctcctctctcatctgctcatggaagaacatcttcagaaggattcagtgacacagcaagtaattggtccccttatacgggttcttggttctggcatacacatcttgcagcagagagctgtaaaggctcttgttagcattgcactaatatggccaaatgaaattgcaaaagagggtggtgtgagtgagttgtccaaagttatattgcaagctgatccttctcttccccatgccttgtgggaatctgctgcttctgttttggctagcattttacagtttagttctgaattttatttggaagttcctgtagctgtcttggtaaggttgctccgttctggcttagaaagcactgtggttggtgcattgaatgctcttttggtgttagaaagtgatgatggaactagtgctgaagctatggctgaaagcggtgccatagaggctcttttggaacttctcagaagccatcagtgtgaggaaacagctgcaaggttgcttgaagtactacttaacaatgtgaaaatcagagaatcaaaagttactaaatctgcgatcttgccattatcacaatacctcttggacccccaaactcaagcacaacaggcaagattattagcaactttggcacttggtgatctattccagaatgagggcctggctcgaagtactgatgctgtgtcagcttgtcgtgctctagtcaatgtgcttgaagagcaacctacagaagaaatgaaagtagtagcaatatgtgctttgcaaaacctggtcatgtatagccgatccaataaaagagctgttgcagaggctggtggtgttcaagttgtattggatgtaattggttcaagtgatcccgatacatctgtccaggctgcaatgtttgttaaactcctcttctccaatcacaccattcaagagtatgcatccagtgaaacagtcagagccataactgctgctattgaaaaggatttatgggccactgggacagtgaatgaggagtatctcaaagctctaaatgccctttttagcaacttcccaaggttgagagccaccgagcctgcaacactcagcataccccatctggttacatctctcaagacaggatcagaagcaactcaagaagctgccttggatgctctttttcttcttaggcaagcttggtcagcatgcccagctgaagtttcaagagctcaatctattgctgctgcagatgcaatccccttgttgcaatacttgatccagtctggcccacctcgatttcaggagaaggctgaatttctgctgcagtgtttgccagggacactcgtggttattatcaagcgtggaaacaacatgaagcagtcggtggggaaccctagtgtttattgcaagattacacttggaagtacaccaccaaggcaaacaaaggtcgtatcaactggtcccaatccggagtttgaggagagcttttcatggtccttcgagagtcctccaaaaggccaaaagcttcacatctcttgcaaaaataagagtaaaatggggaagagttctttcggcaaagtaacaatccagattgatcgggttgtaatgcttggagcagtagctggggaatacactctgttgccacaaagcaagagtggaccctcaaggaatttggagattgaatttcagtggtcaaacaagtaagtaacaaatgttaatgacgtagcaaccattcggcccaaattgagattttagggagataacatgcctcccatcaacacagaattctttctcttccttgtttcttctccagtctggtttatttatcatcctcctcttttcagttgtaaatagtttgccagaagaatttgatttttgtagctgtttgccaaaagccgtaagatagcaatttgttcaaatgtattcttttgcaaccctagtttcttcaagttttctccttgtacccatattattgtgcttgccaacctgagaggaaaataataatcatggttctggtttcggatattaatcgtctttttagccatgtttgtcagagcatatattaatccatctttgtatatggttcatcctatcagctgtgttttcattattatcgaacaataatatttgaaaggttctcttgat

SEQ ID NO: 290 - DNA, 6951 bp, Populus trichocarpa
atgaaatgaagtgaagtgcctttttattatcttcccttctcttctacgatacctgtagatgctcctccgcctcttctctctctccctctagaggagagtttgatgtcttgattgtgtaaaataaggtagatctggagacagactcattcttttaagggaaaaaaaggagaagatggcggctacactcgcttggaggttatctgctaccaatggcagcagccttgccactactgatctggaaaaaaatggcaatctaaaaactcaagattcagagcctccaactccccgttcagttatgaagatgggtgtgagagaccgtactggtagcatggaggatccagatggcacactagcaagtgttgcacaatgcattgagcagctgcgccggagctcctcatctgtacaagagaaggagtatgcattgagacagttgcgagaacttgttgagacgcgtgaaaatgctttcagtgctgttggatctcactctcaagcagttccggtgcttgtttctcttctccggtccggatcactgggggttaagatacaggctgctactgtcttaggttctctctgcaaggagaatgaactaagggtaaaggtcttacttggaggatgcatcccaccgttgctaggtctgctcaagtctagctccgaagaaggtcaaattgcagcagcaaagacgatatatgctgtgtctcagggtggtgctaaggatcatgttggatcaaaaattttttcaactgaaggagttgtgcctgtgctctgggagttgcttcgtaatgggctcaaaacaggtaaattagttgataacttgttgactggagcattaaaaaacctctccagcagcactgagggattttggtctgcaacaatacaagctggaggagtggatattctggttaagttgctcacaacaggacagtcagacacacaagctaacatctgctttcttcttgcgtgcatgatgatggaagatgaatctatttgttccaaagtattagctgcagaggctactaaacagttgctcaagctgttaggacctggcaatgaagcctctgttagagcagaagctgcaggtgcccttaagtctctttctgcacagtgcaaagatgcaaggcaagagatagctaaatctaatggtattcctgctctgataaacgctacaatagctccttcaaaagaattcatgcagggggagtatgcccaagcattacaggagcatgcaatgtgtgccctggcaaatatttctggtggcttgtcatttgttatctcaagcctcggtcaaagccttgaatcatgctcttctcctgcccagactgctgatactttaggagctttggcttcggctttgatgatatatgatagcaaagctgaatccaccagggcatcagatcctgttgttattgagcagactttagttaatcagttcaatcctcatttaccatatcttgtgcaggaacgtaccatagaagcattagctagtttgtatgggaatgccatactttcagttaaactcgcgaattctgaagcaaaacggttgcttgttggtttgattacaatggcaaccaatgaagttcaggatgagcttgtaagagctcttcttgcactttgcaataatgaaggcagtctatggcgttcgcttcaaggacgtgaaggagttcagctattgatatcccttcttgggctttcatcagaacagcagcaggaatgtgcagtggcgttgctttgccttctatctaatgaaaacgatgaaagcaagtgggccatcactgctgctggtggtatacccccccttgttcaaattctagagacaggatccgctaaagccaaggaagattctgctactatccttaggaacttgtgcaatcacagtgaagatatacgtgcatgcgttgaaagtgctgatgctgttcctgcattgctatggctactgaagaatgggagcctcaatgggaaagaaattgcagcaaagactttaaatcatttgatacataaatctgatacagctactattagccagctcactgcattgttaaccagtgatctacctgaatcaaaagtgtatgtcctggatgctctaagaagcatgctttctgtagttcacttgagtgatgtgctacgggagggcagtgctgcaaatgatgcgattgagacaatgattaagatattgagctctactaaagaagagacccaggccaagtctgcctctgctttggctggaatttttgaaactagaaaggatttacgtgaaagcagcatctctgttaaaacactttggtcagtgatgaagttgctaaatgttgaatctgaaaacatcttagcagagtcatctcattgtcttgcttcgatatttctttcaattaaagagaaccgggatgtggctgctgttgctcgtgatgcgttatcccctttaattgcactagctaactcatcgaccttggaagttgctgaacaggcgacatgtgctcttgcaaatcttattttggatggtgaagtttcaaaaaaagcaattccaaatgaaattattgtgcctgcaacaagggttttgcgtgaaggcacaatttctggaaagacccatgcagcagcagcgatcgctcgtctccttcattctcgtagaattgataattccataactgattgtgtcaatcatgctggaacagtactcgcattagtttcttttctagaatctgctattggcagatctgctgccacatcagaggctctggctgcacttgctattttgtcaaggtcagaaggggctagcggacacatcaaaccagcatgggcagttttagctgaatttccaaaccacatatccccaatagtttcgtcgattgcagatgcaacacccttgttgcaggacaaggctatcgaaatattgtcacgactttgccgagatcagccttttgttttaggaaatgcggttgctagtgcctctggatgtataccgtctgtggctagaagggcgattgattccacaagcccaaaggtcaaaattgggggagctgcacttcttatttgtgctgcaaaagttagtcaccagagggtggtggaagatcttaaccaatcaaattcatgtaatcaccttattcaatcacttgtcacaatgctttgttctgcagacacttctccttcaggaaacctggttgatgatgacagggaggtcattagcatatacagacatgctaaagaaggtgagagtggtgaatcccataaagcaacagcagttatttatgattataacttggctgtttggctactttcggttcttgcctgccacggtgagaaaagtaaaattgttataatggaggctggagcagttgaagtcctcactaacagaatctccagttgttatttgcagtacagtcagagtgattttagtgaagacagcagcatatggatttgtgctctactgctagcaattctgtttcaagacagagacatcatacgtgcgcatgcaaccatgaaatctataccagcacttgcaaacttgttgaagtcagaggagtctgcaaacagatattttgctgcacaggcaatagccagcctagtgtgtaatggtagtcggggaacacttctgtctgttgcaaattctggggcagcaggtggactcatctccttacttggctgtgctgatggtgatatatctgatcttctggaattgtccgaggagtttgctttggtatgttatccagaccaagttgcgcttgagaggttattcagagttgaagacattagagttggtgctacatctcgcaaagcaatacctgctcttgtcgatctgctcaaaccaattccagatcgtcctggggcaccttttctagcattaggacttctaaatcagttagcaaaagactgtcctccaaataagactgttatggttgaatcagggattttggaggccctgactaagtatctttcacttggtctgcaagatgcaaccgaggaagctgcaactgatctgttagggatcctatttagtagtgctgaaattcggagacatgaagctgcatttggtgctgtcagtcaacttgttgctgtcctgcgtatgggtggaagagctgcaaggtacagtgctgctaaagctttggaaagcttgttttctgctgatcatatcaggaatgcagacactgcccggcaagctgtccaacccttggtggaaattcttaatactggtctagagaaagagcagcatgctgctattgctgcattggttaggttattgagtgaaaacccatctagagcccttgcatttgcagatgttgaaatgaatgcggtggatgtcctttgcaggatcctctcatcaaattgctcaacagggctgaagggggatgctgcggagttgtgtggtgttttgtttggaaacacaagaatcaggtctacaatggctgcagcacgctgtgttgagcctctggtatctctccttgtaactgagttcagtcctgcccagtattcagttgtctgtgcattagataagcttgttgatgatgagcaactggcagaactggtcgctgcacatggagcagttattcctctcgttggccttctctatggtgggaattacatgcttcatgaggctatctcccgggcacttgtgaagttggggaaagacaggcccgcatgtaaaatggaaatggtaaaagctggagtaattgaaagcatacttgatatcctccatgaagcaccagattttctctgtgcagcatttgctgaattgctcagaatattgaccaataatgccagcattgccaaggggccgtctgctgcaaaagttgttgggccccttttcctgctgctgacaagaccagaatttgggcccgatggacaacatagtgctttgcaggttctagttaatattctggaacatccacagtgccgtgcagattataacctcacctctcaccaaactattgagccactcatcccattgcttgattctcaggctccagcagtgcaacagctggctgctgagcttttgtcacatctgctcatggaagaacatcttcagaaggatccagtgacacagcaagtaattggtcctcttatacgggttctcagttctggtatacacatcttgcagcagagagctgtaaaggctcttgttagcattgctctaatatggccaaatgaaattgcaaaggagggtggtgtgagtgagttgtccaaagttatattgcaagctgatccttctcttcctcatgtcttgtgggaatctgctgcttctgttttggctaacattttacagtttagttctgaattttatttggaagtgcctgtagctgtcttggtaaggttgctccgttctggtttggaaagcacggtggttggtgcactgaatgctcttttggtgttagaaagtgacgatggaacaagtgctgaagctatggctgagagtggtgccatagaggctcttttggaacttctgagaagccatcagtgtgaggaaacagcagcaaggttgctggaagtattacttaacaacgtgaaaatcagagaatcaaaagctactaaaactgcaatcttgccattgtcgcaataccttttagatccccaaactcaagcacaacaggcaagattactggccactttggcacttggtgatctattccagaatgagggcctggctcgaagcaccgatgctgtttcagcttgtcgtgctctagtcaatgtccttgaagagcaaccaacagaagaaatgaaagtagtagcaatatgtgctttgcaaaacctggtcatgtatagccgatctaataaaagagctgttgcagaggctggtggtgttcaagttgtattggatctaatcggttcaagtgatccagatacatctgtccaggctgcaatgtttgttaaacttcttttctccaatcacaccattcaagagtatgcgtccagtgaaacagtcagagccataacagctgctatcgaaaaggatttatgggccactgggactgttaatgaggagtatctcaaatctctaaatgccctttttagcaacttcccaaggttgagagccaccgagcctgcaacgctcagtataccccatttggttacatctctcaagacaggatcagaagcatctcaagaagctgccttggatgcactgtttcttcttaggcaagcttggtcagcatgcccagctgaagtttccagagctcaatccattgctgctgcagatgcaatccccttgttgcaatacttgattcaatctggcccacctcgatttcaggagaaggctgaatttctgctgcagtgtttgccagggacattggtggttattatcaagcgtggaaacaatatgaagcagtcggtggggaacccaagtgtttattgcaagcttacccttggaaatacaccacccaggcaaacaaaggttgtatcaacgggtcctaatccggagtttgatgagagcttttcatggacctttgagagtcctccaaaaggccaaaagcttcatatctcttgcaaaaataagagtaaaatggggaagagttctttcggaaaagtaacaatccagatcgatcgggttgtaatgctaggagcagtagctggggaatacaccctgatgccagaaagcaaaagtggaccctcgaggaatttggaaattgaattccagtggtctaacaagtaacagatgctaaagacgagacaatcagtcggcacagattgagattttagggagaaaatatgatcaattcggttacttatccccattccagtgtaaatagtttgccagagaatctgatttttgtagttgtttgccaagagccgtaagatagcaattttttcaaacgtattcttttgtaatccgagtttcctataatatttctgggctgaaccacaagaacaaacatacaagttttctttgtaatttttgttacccatagtaacgtgcttgtcaaaccgagatgaaaataataataataataataataacaaccgttctggtttcgg

SEQ ID NO: 291 - DNA, 6767 bp, Glycine max
ctggcgactacactcacttggaggtttgctgccagtaatggcagcacccttgctgctaatgatatggaaagaaatggtgatgggaaggctcaagattcagaggctctacctcctcattctgttctgaagatgggattgagagaacgtagcaacagcagcagcatggaggatccagatgggacattagcaagtgttgcccaatgcattgagcagctgcgtcagagctcatcttctatgcaagagaaagagtattctttgaagcagttattggagcttattgatatgcgagaaaacgctttcagtgctgttggctctcattctcaggcagttccagtacttgtttcccttctccggtcagggtcattgaatgtgaagatacaggcagcaactgtcttgggctcactttgtaaagaaaatgagcttagggtgaaagtcttgcttggaggttgcattcctcctttgcttggtctactcaagtccagttctgctgaaggtcaagtagctgcggcaaagactatttttgctgtctctcaaggtggtgccaaagatcatgttggatcaaaaattttttcaactgaaggagttgttccagtgctatgggagcagctgcaaaagggcctgaagactggaaatgtagttgataatttattgactggggcattgaaaaatctctccagtagcactgagagattctggaatgccacaatacaagctggaggagtggacatattaattaagttactgacaacagggcagtctagcactttagcaaatgtgtgctttttactggcttgtatgatgatggaggatgcatctgtttgttcaaagttgttgacagcagaggcaacaaaacaactcctcaaacttttaggccctggtaatgatgcccctgtcagggctgaggcagccggtgctcttaaagctctatctgcccagtgcaaagatgcaaggaaagagatagccaattccaatggcattcctgctttgattaatgctaccatagctccttccaaagagttcatgcagggtgagtatgctcaagcgttacaggagaatgctatgtgtgctttagcaaacatttctggtggtttgtcatatgtcatctccagtcttggtcaaagccttgaatcatgctcctctcctactcaagctgccgacacattgggggctttagcttcagctcttatgatatatgatgacaaggcagaatctaccagggcatcagatcctttggtagtagagcagacattacttgaacaatttaaacccggcttaccattccttgtgcaggaacggaccattgaagccctagctagtttgtatagcaatcctatactgtcaattaaacttacaaattctgatgcaaagcgtttgcttgttggtttaataacaatggctgctaatgaagtgcaagatgagcttctaaaatctctcttgacattgtgcaatactgaatgcagtctatggcttgcacttcaaggccgtgaaggagttcagctgttgatatctcttctggggctttcatcagaacagcagcaagaatgtgctgtttccctcctttgccttttatctaatgaaaatgatgaaagcaaatgggccattactgctgctggtggtatacctcctcttgttcaaattttggagtcaggatctgcaaaagcaaaggaagactcagcaacaatccttaggaacctatgcgatcacagtgaggatatacgtgcttgtgttgaaagtgctgatgccgttcctgcattgctgtggctgttgaagaatggaagcccaaatgggaaggagattgcagccaagactttgaatcacttaattcataaatctgatacagcaactatcagtcagcttacagcattattgaccagtgatttacctgaatctaaggtttatgttttagatgctttgaggagtatgctttcagttgttgctcttactgatcttctacgtgaaggtagtgctgccagtgatgcaattgttacaatgataaaacttttgagctcaaccaaggaagaaactcaggcaaagtctgcatctgctctggcgggaattttcgaaacgaggaaagatgtgcgtgaaagcagcattgctgttaaaactctttggtcagcaatgaagttgcttaatgttgaatctgaaagtatcttaatggagtcctcgcgctgcttggctgcaatatttctttccatcaaagagaacaaggatgtggctgctattgctagagatgcattactctccctagttgcactagctaactcttcagttttagaagtggcagagctggcaacatgtgctgtggcaaatcttattttggatagtgaaattgctgagaaagctgttgcagaagaggtcatcttggctgctaccagagtattacgtgaaggcacaatttctggaaaaacacatgctgctgcagcaattgctcgcctcttacattgtaagaggcaagttgattatgctgtaactgattgtgtgaatcgagctggcactgttcttgcattagtttctttcttagattttgctattgatggacatagttccacatcagaagctcttgaagcacttgccatgctgtccaggtcagatgtgaccggtgcacacagtaaacctgcttgggcagttttagctgaatttcctaaaagcataagcccgatagttttgtctattgctgattcaacgtcagtgttgcaggataaagctattgaaatattatctcgattatgtaaggatcagccttttgttctgggagacagtgttgttactgcctctggatgtatatcttctatagctaagaggataatcaattccacttctaaaaatgtaaaggtcaaaattggaggggctgctgttcttatttgtgctgctaaactaaatcatcagaggctggtggaggatctcaatagatcaaacttgtgtgctaatcttgttcagtctctggtcgatatgcttatttcttcacaggctactttggataatcagggtgatgacagcagggaagttatcagcatttgcaggcatacaaaagaagccaatgatggtaaatcaaacactggtaccgctattatttctggtgccaacttagctgtatggttactgtctgttcttgcttgccatgatgaaaaaagtaaaattgcaataatggaggcaggagcaattgaggttctcactgacaggattgcagattgtttctcacaatatagtcagattgactataaagaagatagcagcatgtggatttgtgctttgttgttggcaatattatttcaagatagggatatcatacgagcacatgcaaccatgaaatctataccagcccttgccaacttattgaagtcagaggaatcagcgaacagatattttgctgcacaatcaatagctagcctagtctgtaatggtagcaggggaacacttctgtctgtggcaaattctggggcagcaggtggacttatctccttgcttggctgtgctgattctgatatacaggatcttctggaattgtcagatgaattttctttggtgcattatcctgaccaagttgctctcgagaggttgtttagagttgatgacataagaattggtgccacttctcggaaggcaatacctgctttagttgatctgctcaaaccaattccagaacgcccaggagcaccatttttagcacttgggcttttgactcagctttctatagattgtccatcaaataagattgtaatggttgaggcaggggccctagaggctctttctaagtatctttcactaggtccacaagatgcaacggaagaagctgctacagatctgttaggaattctgtttagcagtgcagaaattcgaagacatgagtcagcagttggagctgttactcaacttgtagctgtcctgcgtttaggaggaagagctgcaagatatagggctgcaaaagctttggaaagtttattctctgctgaccatattagaaatgcagagactgctcgacaagctgttcaacccttggtggagattcttaatactggtttagagagagagcagcatgctgcaattgctgcattggttaggttactgagtgaaaacccttcaaaagcacttgctgttgcagatgttgagatgaatgcagtggatgttctttgcaggattctctcatcagattgctcaatggacctcaaaggggatgctgctgaattatgttctgttctttttggaaataccaggattcggtccacaatggctgctgcacgttgtgttgaacctctggtctctctccttgtaagtgagtttagtcctgctcaccattcagttgtccgtgcattggataggcttgttgatgatgagcaactggctgaattagttgctgcacatggtgcagttattcctcttgttggcctactttatggtaggaattatgtacttcacgaggccatttccagagctctggtcaagttaggaaaagacaggccagcttgtaaaatggaaatggtgaaagctggagttattgaaagcatacttgacatccttcatgaagcacctgattatctgtgtgcagcttttgcagaattgttgcgtatattgaccaacaatgctagcatagctaaagggccatcggctgctaaagtagttgaacccctgtttatgttgctgacaagagaagaatttgggccagatggacaacatagtgcattgcaggttttagttaatatcttagaacatccgcagtgtcgtgctgattactcattgacttctcaccaagttattgaacctcttatccctttgcttgattctccaatatcagcagtgcaacagttggctgctgagcttctctcgcatctacttttagaagaacaccttcagaaagatccggtgacgcaacaggtaattggccctcttatacgagttcttggttctggtatacatatattgcagcaaagagctataaaggccctggttagtattgcactgatatggccaaatgaaattgcaaaagaaggtggtgttattgaaatttcaaaagttatattgcaatctgatccttccattcctcatgctttatgggagtctgctgcctctgttttggctagtattctacaatttagttctgaatactacttggaagttcctgttgctgttttggttaggctgcttcgatctggcttagaaagcactgttgttggtgcattaaatgctcttcttgtgttggaaagtgatgatggaactagtgctgaagcaatggctgaaagtggtgctatagaggctctcttggagctcctgggatctcatcagtgcgaggaaactgctgcaagactgttggaagttttgctccacaatgtaaagatcagagaaacaaaagttactaagtcagccatcttaccattatcccattatctcttggacccacaaacccaagcacaacaagcaaggttgttagcaactttggctcttggtgatctatttcagaatgagggtcttgctcggacaagtgatgcagtttcagcttgtcgcgctttagtgaatgtgcttgaagaccaaccaactgaagaaatgaaagttgtagccatatgtgctctgcaaaaccttgtgatgtacagtcgatcaaataaaagagcagttgcagaggcgggtggggttcaggttatactggatctgataggttcaagtgatcctgaaacatctgttcaggctgcaatgtttattaaacttctattttcaaatcataccattcaagagtatgcttctagtgaaacagtcagagcaataactgctgctattgaaaaggacttatgggctactggatctgtgaacgatgagtatcttaaagccttaaattctctatttagcaacttcccaagactgagagcaactgaaccagcaacacttagcattccccatttggttacgtccttaaagacaggctctgaggctactcaggaagctgccttggatgcacttttcctgcttaggcaagcttggtcagcatgtccagcagaagtttcaagagctcagtcaatagcagctgcagatgctattcctttgctgcagtacttaatccagtctggcccacctcgctttcaggagaaggcagaatttttattgcagtgtttgccaggaacgttggtggtgatcatcaagtgtggtaacaatatgaagcaatctgttggaaacccaagtgttttttgcaagcttacactaggaaacactcctccaaggcaaaccaaggtggtctcaactggccctaatccggagtgggatgagagctttacatggtcgtttgagagtcctccaaaaggtcagaagcttcacatttcttgcaaaaacaagagcaaaatgggaaagagttcatttgggaaagtgacgatccagattgatcgggtagtaatgcttggagcagtatctggtgagtacactctgttgccggaaagtaaaagtggaccctcgaggaatttagaaattgaatttcagtggtctaacaagtgatatacctgtttccgtctttactgtgacggctttgaaattggaacacggttgaaaagaaatttttgtctaaattttgtattatttatcttgctagtgtacatagccacagttatttgttttttggtctatagtcccaaacaaattcttttaaaataatattcttttgtaacttgatccttcgttccctaggttaaatgctaggggcacacgaagtaatctgcttcgaatacctgtatgattttgcacgttgtcaatttaagatgggttgtttatatataaatatatatctaagatttttt

SEQ ID NO: 292 - DNA, 6781 bp, Glycine max
ggagagggagcagtgtcctggattgatctgcttggaggagaattcgagtgacgcggagcgaagctggcgactacactgacttggaggtttgctgccaataatggcagcacccttgctgctaatgatatggaaagaaatggtgatgggaaggctcaagattcagagcctctacctcctcattcagttctgaagatgggattgagagaacgtagcaacagcagcagcatggaggatccagatgggacattagcaagtgttgcccaatgcattgagcagctgcgtcagagctcatcttctatgcaagagaaagagtattctttgaagcagttattggagcttatagatatgagagaaaatgctttcagtgctgttggatctcattctcaggcagttccagtacttgtttcccttctccggtcagggtcattgaatgtgaaaatacaggcagcaactgtcttgggctcactttgtaaagaaaatgagctgagggtgaaagtcttgcttggaggttgcattcctcctttgcttggtctactaaagtccagttctgctgaaggtcaagtagctgctgcaaagactatttttgctgtctctcaaggtggtgccaaagatcatgttggatcaaaaattttttcaactgaaggagttgttccagtgctatgggagcagctgcaaaagggcctgaagactggaaatgtagttgataatttattgactggggcattgaaaaatctctccagcagcactgagagattctggaatgccacaatacaagctggaggagtggacatattaattaagttactgacaactgggcagtctagcactttagccaatgtgtgctttttacttgcttgtatgatgatggaggatgcatctgtttgttcaaagttgttgacagcagagacaacaaaacaactcctcaaacttttaggccctggtaatgatgcccctgtcagggctgaggcagctggtgctcttaaatctctatctgcccagtgcaaagatgcaaggaaagagatagccaattccaatggcattcctgctttgattaatgctaccatagctccttccaaagagttcatgcagggtgagtatgctcaagcgttacaggaaaatgctatgtgtgctttagcaaacatctctggtgggttgtcgtatgtcatctccagtcttggtcaaagccttgaatcatgctcctctcctactcaagctgctgacacattgggggctttagcttcagctcttatgatatatgatgacaaggcagaatctacctgggcatcagatcctttggtagttgagcagacattacttgaacaatttaaacctcacttgccattccttgtgcaggaacggaccattgaagccctagctagtttgtatagcaatcctatattgtcaattaaacttacaaactctgatgcaaagcgtttgcttgttggtttaataacaatggctgccaatgaagtgcaagaggagcttctaaagtctctcttgacattgtgcaatactgaatgcagtctatggcgtgcacttcaaggccgtgaaggagttcagctgttgatatctcttctggggctttcatcagaacagcagcaagaatgtgctgttgccctcctttgccttttatctaatgaaaatgatgaaagtaaatgggccattactgctgctggtggtatacctcctcttgttcaaattttggagtcaggatctgcaaaagcaaaggaagactcagcaacaatccttaggaacctatgcgatcacagtgaggatatacgtgcttgtgttgaaagtgctgaagtcgttcctgcattgctgtggctgttgaagaatggaagcccaaatgggaaggagattgcagcaaagactttgaatcacttaattcataaatctgatacagcaactatcagtcagcttacagcattattgactagtgatttacctgaatctaaggtttatgttttagatgctttgagaagtatgctttcagttgttgctcttactgatcttctacgtgaaggtagtgctgctagtgatgcaattgttacaatgataaaactattgagctcaaccaaggaagaaactcaggcaaagtctgcatctgctctggcgggaatttttgaaacgaggaaagatgtgcgtgaaagcagcattgctgttaaaactctttggtcagcaatgaagttgcttaatgttgaatctgaaagtatcttaatggagtcctcgcgctgcttggctgctatatttctttccatcaaagagaacaaggatatggctgctattgctagagatgcattaccctccctagctgcactagctaactcttcagttttagaagtggcagagctggcaacatgtgctgtggcaaatcttattttggatagtgaaattgctgagaaagctgttgcagaagaagtcatcttggctgctaccagagtattacgtgaaggcacaatttctggaaaaacacatgctgctgcagcaattgctcgcctcttacattctaagaggcaagttgattattctgtaactgattgtgtgaatcgagctggcactgttcttgcattagtttctttcttagactttgctattgatgaacatagttccacatcagaagctcttgaagcacttgccatgctttccaggtcagatttgaccagtgcacacagtaaacctgcttgggcagttttagctgaatttcctaaaagcataatcccaatagttttgtctattgctgattcaacgccagtgttgcaggataaagctattgaaatattatctcgattatgtaaggatcagccttttgttctgggagacactgttgttactgcctctggatgtatatcttctatagctaaaaggataatcaattccacttctaaaaatgtaaaggtcaaaattggaggagctgctgttcttatttgtgctgctaaagtaaatcatcagaagctggtggaggacctcaatttatcaaacttgtgtgctaatcttgttcagtctctggtcgatatgcttattttttcacaggctacattggataatcagggtgatgacagcagggaagttatcagcatttgcaggcatacaaaagaagccaatgattgtaaatcaagcactggcaccgctcttatttccagtgccaacttagctatatggttactgtctgttcttgcttgccatgatgaaaaaagtaaaattgcaataatggaggctggagcaattgaggttctcactgacaggattgcagattgtttctcacaatatagtcagattgattataaagaagatagcagtatgtggatttgtgctttgttgttggcagtattatttcaagatagggatatcatacgagcgcatgcaaccatgaaatctataccagcccttgccaacttattgaagtcagaggaatcagcgaacagatattttgctgcacaatcaatagctagcctagtctgtaatggtagcaggggaacacttctgtctgtggcaaattctggggcagcaggtggacttatctccttgcttggctgtgctgattctgatatacaggatcttctggaattgtcagatgaattttctttggtgcattatcctgatcaagttgctcttgagaggttgtttagagttgatgacataagagttggtgccacttctcggaaggcaatacctgctctagttgatctgctcaaaccaattccagaacgcccaggagcaccatttttagcacttgggcttttgactcagctttctatagattgtccatcgaataagattttaatggttgaggcaggggccctagaggcactttccaagtatctttcactaggtccgcaagatgcaacggaagaagctgctacagatttgttaggaattctgtttagcagtgcagaaattcggagacatgagtcagcatttggagctgttactcaacttgtagctgtcttgcgtttaggaggaagagctgcaaggtatagggctgcaaaagctttggaaagtttattctctgctgaccatattagaaatgcagagactgctcgacaagctgttcaacccttggtggagattcttaatactggtttagagagagagcagcatgctgcaattgctgcattggttaggttactgagtgaaaacccttcaaaagcacttgctgttgcagatgttgagatgaatgcagtggatgttctttgcaggattctctcatcagattgctcaatggacctcaaaggggatgctgctgaattatgttctgttctttttggaaatacaaggattcggtctacaatggctgctgcacattgtgttgaacctctggtctctctccttgtaagtgagtttagtcctgctcaccattcagttgtccgtgcattggataggcttgttgatgatgagcaactggctgaattagttgctgcacatggtgcagttattcctcttgttggcctactttatggtaggaatcatgtacttcatgaggccatttccagagctctggtcaagttaggaaaagacaggccagcttgtaaaatggaaatggtgaaagctggagttattgaaagcatacttgacatccttcatgaagcacctgattatctatgtgcagcttttgcagaattgttgcgtatattgaccaataatgctagcatagctaaaggaccatcggctgctaaagtagttgaacccctgtttatgttgctgacaagagaagaatttgggccagatggacaacatagtgcattgcaggttttagttaatatcttagaacatccgcagtgtcgtgctgattacacattgacttgtcaccaagttattgaacctcttatccctttgcttgattctccaatatcagcagtgcaacagttggctgctgagcttctctcgcatctacttttagaagaacaccttcagaaagatccggtgacgcaacaggtaattggccctcttatacgagttcttggttctggtatacatatattgcagcaaagagctgtaaaggccctggtcagtattgcattgatatggccaaatgaaattgcaaaagaaggtggtgttattgaaatttcaaaagttatattgcaatctgatccttccattcctcatgctttatgggagtctgctgcctctgttttggctagtattctacaatttagttctgaatactacttggaagttccagttgctgttttggttaggctgcttcggtctggcttagaaagcacagttgttggtgcattaaatgctcttcttgtgttggaaagtgatgacggaactagcgctgaagcaatggctgaaagtggtgctatagaggctctattggagctcctaagatctcatcagtgcgaggaaactgctgcaagactcttagaagttttgcttaacaatgtaaagatcagagaaacaaaagttaccaagtcagccatcttaccattatcccattatctcttggacccacaaacccaagcacaacaagcaaggctattagcaactttggctcttggtgatctatttcagaatgagggtcttgctcggacaagtgatgcagtttcagcttgtcgtgctttagtgaatgtgcttgaagaccaaccaactgaagaaatgaaagttgtagccatatgtgctctgcaaaaccttgtgatgtacagtcgatcaaataaaagagcagttgcagaggcgggtggggttcaggttatactggatctgataggttcaagtgatcctgaaacatctgttcaggctgcaatgtttattaaacttctattttcaaatcataccattcaagagtatgcttctagtgaaacagtcagagcaataactgctgctattgaaaaggacttatgggctactggatctgtgaatgatgagtatcttaaagccttaaattctctatttagcaacttcccaagactgagagcaactgaaccagcaacacttagcattccccatttggttacgtccttaaagacaggctctgaggctactcaggaagctgccttgaatgcacttttcctgcttaggcaagcttggtcagcatgtccagcagaagtttcaagagctcagtcaatagcagctgcagatgctatacctttgctgcagtacttaatccagtctggcccacctcgctttcaggagaaggcagaatttttattgcagtgtttgccaggaacattggtggtgatcatcaagcgcggtaacaacatgaagcaatctgttggaaacccaagtgttttttgcaagcttacactcggaaacactcctccaaggcaaaccaaggtggtctcaactggccctaatccggagtgggatgagagctttacatggtcctttgagagtcctccaaaaggccaaaagcttcacatttcttgcaaaaacaagagcaaaatgggaaagagttcatttgggaaagtgacaatccagattgatcgggtagtaatgctaggtgcagtatctggagagtacactctgttgccggaaagtaaaagtggaccctcgaggaatttagaaatagaatttcagtggtctaacaagtgatacccgtttctgtctttagtgacagcttttaaattggaaaacaggatacatggttgaaaacaaatttttgtctaaattttgtattatttatcttgctagttcccaaacaaattcttttaaaataatattcttttgtaacttgatccttggttccctaggttaaatgcctaggggcacacgaagattaggtctgctacgaatcctgtatgatttttgcacgttgtcaatttaaagtgccttgtttatatat

SEQ ID NO: 293 - DNA, 671 bp, Brassica napus
gggtcgcatattgagaagtagatttggtttccggttctttgaagaaaaacaatggcttgggacttgttcttatggattctctccttcttcgtcagcttagccctcgtcgcttccgtcttctatcaggttatatgtttaacggatttagaagcggattacttgaacccttttgaaacatcaacccgtatcaaccgattgatactacctgagtttatcctccaaggctcactctgtgttctcttcctcatcacatggcattgggtgttttttctcgcggctctccctgtaacatgctatcacgctatgctatacaaagagcgacgacatctcattgatgtcactgaagtgttccgtggtattagctttgaaaagaagctccgtttcaccaagctcgggttctacatctttctcttcatcatggttgtctttaggctcactctctcagcggtctatagcttcacagaggatgatgatctacttcacttgttttgatgcatctctatttgttttcttagtgtgtgatagacttttatgacagctggttctacattcccttcttagtattagtgaaattagggatttaatctaaatctcacaggacaacagattgttcacaagctaaattgaaaacttattagagaaaaaagaaggaaagtttcagtatttgaaga

SEQ ID NO: 294 - DNA, 648 bp, Raphanus sativus
gaaaagagtcgtacattgataagtagagtttggtctctcgattctttttctttttcgaagaaacaaaatggcttgggatttgttcttatggatcctctccttcttcgtcagcttagctctcgtcgcttccgtcttctatcaggttatatgtttaacggatttagaagctgattacttgaacccttttgaaacatcatctcgtatcaaccgattgatactacctgagtttatcctccaagcctcactctgcattctcttcctcatcacatggcattgggtgttttttctagtcgctctccctgtaacatgctatcacgctatgctatacaaagagcgaagacatctcatagatgtcactgaagtgttccgtggtattagctttgaaaagaagctccggtttaccaagctcggtttctacatctttctcttcatcatggttgtctttaggcttactctttcagcggtctatagcttcactgaggatgatgatctacttcatttgttttgatgtactcttatttgttttctcagtgtgtgtgttgtgttatagacatttcttagggatttactcaaaacttcacaggacatcagattgctctcacaagctaaatcgcaaactaattagagaaaaaaaggaagatttccata

SEQ ID NO: 295 - DNA, 765 bp, Raphanus sativus
ggaaaggaagcaagtaaagagtcttcgtacattgagaagtagagtttggtctctcgattctctttttgtcgaagaaacaaaatgggttgggatttgttcttatggatcctctccttcttcgtcagcttagccctcgtcgcttccgtcttctatcaggttatatgtttaacggatttagaagctgattacttgaacccttttgaaacatcatctcgtatcaaccgattgatactacctgagtttatcctccaagcctcactctgcattctcttcctcatcacatggcattgggtgtttttcctcgtcgctctccctgtaacatgctatcacgctatgctatacaaagagcggagacatctcatcgatgtcactgaagtgttccgtggtattagctttgaaaagaagctccgttttaccaaactcgggttctacatctttctcttcatcatggttgtctttaggcttactctttcagcggtctatagcttcactgaggatgatgatctacttcatttgttttgatgtactctatttggttttctcagtgtgtgtgttgtgttatagacatttcttagggatttactcaaaaacttcacaggacaggacatcagattcctctcccaagctaaatcgcaaactagttagagaaaaaaggaagatttccatatttagcaagtagagaaaaatggctttggtctcatttctcaaaacttgatcatgttccttggttgagtttgtcagaagactagagtgctttgagaaaaa

SEQ ID NO: 296 - DNA, 583 bp, Thellungiella halophila
gggagaatcattcacggaaacgatgagcgtctctctgttaacggccttggccgttctctcactctgttcacacacttcaacatctgagtttcagctctccagcatatcagctgcaccttcgtttttgcctgaagctccatggagtttctcagcttctcctccggctatgtctccagatatatcgcctctgttccctactccaggttccagggaaatgtctccttctccgtcagagtcttcagtcatgccgacaatcccctcaagccttagtccaccaaacccagatgcggtctctcctgatcatctgctagactcttctccggctgggtcccctcttcctgcgtcttcctcaatttgtttggtctcgtcaccacactctctgcttcttgtcttcctcatgttgctgctacgtttctagttaatcattttagagagagagagagagggtgagaataactctctttgacatcttgtgatttcggaatgtaatcttactctgctgcttcttctgaatatttttaaaccctgtaatgtaatgtaatgttttgggatatagcattgattgttggtgcgagatttgctc

SEQ ID NO: 297 - DNA, 1259 bp, Brassica rapa
ggcgacttagggttttagcataaacctcgccgcaccctctctctgtttaagccgtcttacatctgcgrsgragaacccttaatttcgcgctctttgcatcaccttgagaagggtcagcgatgaggaagctcaagaaccatgagaagaaggttctgaagaaagtaaatttcctggaatggaaaagagaaggcggccatcgcgaaaccctgatcacgggtcgttaccacatgggtggtcgtgrcgactacaaaaaatattcaggattgtgtaggatggtgcagaagctgacgaacgtgttgaaacagatggatgcgactgatccttttaggattcagatgactgatatgcthctcgagaagctatacaacatgggagttataccgacaaggaaaagcttggctttaactgatcggttatcagtttcctccttctgcaggcgtaggttatcgactgtgttggttcacctgaagtacgctgagcacttgacagaggcagtgacatacatagagcaaggacacatccgtgtaggaccagacacgatcactgatccagccttcttagtaactcggaacatggaagatttcatcacytgggtggactcttccaagattaaacgcaaggtgcttcartacaacgacaarttggatgactacgacatgcttgcttagatttrtctcacttctcaaagtgtaaaccttttctattaccaaactatatgtttctcattaatcatcaaaccttttgcaatagattcagaccaaagcttagagtaagacaagaaaacaaagattcaatcaaaagtactttgacatctgaatccctttattaaccaacccacatttctcgtagaactctttcttctccacgccacaatcaagaatcaccttgtagcaacccatccctcgacaatgatccgttagaaactcaaccactcgcttcccgagacgtttcccgcggaactctgtatccacgacgacgtcctctacatgcccgactttgccgcagtttctcaggaacttcttctctatcatcacgctccccgtcgccgcgatcttacctgatgactcttcttcgatgacgcagatcaaatggtcgtctccgtaggaggtgatctccttgaaacgctgatcgaattcgtcgtcggtgactgatcctgtgacggtgagttggctgagaagctccatgtatccatttctcttgtcggtgatctctarssktcggatcttgaatgtctgtttctctccggtgatgtcggaact

SEQ ID NO: 298 - DNA, 791 bp, Brassica napus
gctctctgcgacttagggttttagaataaacctcgccgcaccctctctctgtttaakccgtcttacatctgcgacgaacaaaaatccctgatttcgcgttgtttgcattaccttgagaaggctcagtgatgaggaagctcaagaaccatgagaagaaggttctgaagaaagtaaatttcctggaatggaaaagagaaggcggccatcgcgaaaccctgatcacgggtcgttaccacatgggtggtcgtgacgactacaaaaaatattcaggattgtgtaggatggtgcagaagctgacgaacgtgttgaaacagatggatgcgactgatccttttcggattcagatgactgatatgctmctcgagaagctatacaacatgggagttataccgacaaggaaaagcttggctttaactgatcggttatcagtttcctccttctgcaggcgtaggttatcgactgtgttggttcacctgaagtacgctgagcacttgacagaagcagtgacgtacatagagcaaggacacatccgtgtaggaccagacacgatcacygatccagccttcttagtractcggaacatggaagatttcatcacctgggtkgaytcttccaagatcaaacgcaaggtgcttcaatacaacgacaagttggatgactacgacatgcttgcttaarakwtrtctcacttctcaaagtgtgtaaaccttttctattaccaaactatatgtttctcatttagtttcagaaattaggacaagaaaacaaagattcaatcaaaagtactttga

SEQ ID NO: 299 - DNA, 984 bp, Vigna unguiculata
gggcgtccgtgccattctttcttctckktctctcacacgcccagtgcagagtgctcatcaccatcttcatcggcgacgacaccgccaggaacatccgaacaagcatcaagttcattggtttcacctctctttcaatccctttactttggaaatcccgtttctgaggtgctgtccaccaattgttcattggttatccttctgtcactttcaactggtgaaaaagaatgaggaagctaaagttccatgaaaagaagcttttgaagaaggtaaattttttggaatggaagagagaaggtggtcacagagagaacttggttatgcaacgccaccacattactggacgggacgattacaaaaaatattcaggtttatgccatatggttcagaagttagttaacatagtgaaacagatggacgcaaaggatccttttagggttgacatgactgacaagcttttggaaaaactctacaacatgggcgtgattccaaccaggcaaagcatcacactatgtgaacgcttaactgtgtcatccttctgtagacgtaggctctcaactgttctggtgcgattaaaatttgctgaacacttgaaagaagctgtcacgtacattgagcaagggcatataagggttggtccagagacggtgacagacccggctttccttgtaactaggaacatggaagacttcattacatgggtggattcatccaaaataaagagaaaggtgcttcagtacaatgacaaattggatgactatgatttaatgaattaagttgaaggctaaatgtcagcttattgttgtttgctttcaaaatatgaaatctgggatgagttttttttttccttgggggcggtggtttagataggcttggattttaatgggattgttttaagttttaaattcataccagattaagttgatgaagatgtaatgaacctggaaattagtgaatcagtatttaaaattrttctgcatttttcca

SEQ ID NO: 300 - DNA, 1781 bp, Brassica rapa
gcccattcccgacagcttacactgcctgagtttgtgctccaaggagtagaagaattctcagagaatgtggcgttcgttgaagctgtgaccggtaaagccgtcacgtacggtgatgtagtgagagatacaaagaggctagccaaagcgttgacctcacttggactaaggaaaggtcaagtaatggttgtggttctaccaaatgtcgccgagtatgggattattgcccttggcattatgtccgccggtggagttttctctggcgctaatccgacggctcttgtctccgagatcaagaagcaagttgaagcttctggtgctagaggaatcatcactgattctactaacttcgaaaaggtgaaggctttaggcttaccggtaatagtgttaggtgaagagaagatcgaaggagcagtgaactggaaagatcttctagaagcaggagacagatctggagataacaacagagagaagattacttcagacagatctatgtgcacttcccttctcttcaggcacaacaggattacaaaaaggagtgatgctcacacatcgcaacctcatagcaaatctttgctctactctcttcagcgtccggtctgaaatgatcggccagatcgtgactcttggtttgattccgttctttcacatttacggtatcgttggaatctgttgtgctacgatgaagaataaaggcaaagttgttgctatgagtcggtatgatctaaggcttttcttgaatgctttgattactcatgaggtcttgtttgcgcctattgttccacctattatattgaatcttgtcaagaatccgatcgtcgatgagtttgatctttctaagcttaaactccgttctgttatgacggctgctgctcccttagcccccgagcttctcactgcctttgaagccaagtttcctaatgttcaagtccaagaggcttacggattaacggagcatagctgcattactttaactcacggtgatcctgataaaggacaaggaatcgcgaaacgaaactctgtcggttttatacttcccaatctcgaggtgaagttcatagatcctgacactggccggtcgcttccgaagaacacttctggtgagctctgtgtgcggagccaatgtgtgatgcaaggttacttcgagaacaaggaagagacggagaagacgatcgatgaagaaggttggcttcacactggagatataggttacattgatgatgatggagacattttcatcgttgatcgcatcaaagaacttatcaatacaagggctttcaggtggctccggcggagcttgaagctattctactcactcatccatcagttgaagacgtagccgttgtgccgttaccggacgaggaagcgggagagattccggtggcttgtgttgtgatgaatccaaaagcgaaagagaaagaagaagacatccttagctttgttgctgcaaatgtggctcactacaaaaagatcagagccgtccattttgtggattcaattcccaagtctctctctggtaaaatcatgaggaggcttctcagagacaacatcctcagcatcaagaaaacgctattctaagtggttgattaacggtttggttatccattagtcgcttaaatttgatcttcttttattaagaatgtctaattattatcaacttcttcaacgtttctgatgtttaacggagtagacaaaactaataacacaccaagacattctactaagtttgttagataatctccgatgtatcaagctctaccagaaaatataaaacgggttcgtag

SEQ ID NO: 301 - DNA, 1904 bp, Brassica napus
taccgtatagtgagtcttattagccgggggaattccctcttttgaaaatggaagctcgaaagcatgrsarkgmmcmcmytykmsgcagtcttatccatctgtgcccattcccgacaagcttacactgcctgagtttgtgctccaaggagtagaagaattcacagagaatgtggcgttcgtagaagctgtgaccggtaaatccgtcacgtacggtgatgtagtgagagacacaaagaggctagccaaagcgttgacctcacttggactaaggaaaggtcaagtaatggttgtggttctaccaaatgtcgccgagtatgggattattgcccttggcattatgtccgccggtggagttttctctggcgctaatccgacggctcttgtctccgagatcaagaagcaagttgaagcttctggtgctagtggaatcatcactgattctactaacttcgaaaaggtgaaggctttgggtttaccagtaatagtgttaggtgaagagaagatcgaaggagcagtgaactggaaagatcttctagaagcaggagacagatctggagataacaatagagagaagattcttcagacagatctatgtgcacttcctttctcttcaggcacaacaggattacaaaagggagtgatgctcacacatcgcaacctaatagcaaatctttgctctactctcttcagcgtccggtctgaaatgatcggccagatcgtgactcttggtttgattccgttctttcacatttacggtatcgttggaatctgttgtgctacratgaagaataaaggcaaagttgttgctatgagtcggtatgatctaaggcttttcttgaatgctttgattactcatgaggtcttgtttgcgcctattgttccacctattatattgaatcttgtcaagaatccgattgtcgatgagtttgatctttctaagcttaaactccgttctgtaatgaccgctgctgctcctttagcccccgagcttctcactgcctttgaagccaagtttcctaatgttcaagtccaagaggcttacggattaacggagcatagctgcattactttaactcacggtgatcctgataaaggacaaggaatcgcgaaacgaaactctgtcggatttatacttccgaatctcgaggtgaagttcatagatcctgacactggccggtcgcttccgaagaacacttctggtgagctctgtgtgaggagccagtgtgtgatgcaaggttacttcgagaacaaggaagagacggagaagacgatcgatgaagaaggttggcttcacactggagatgtaggttacattgatgatgatggagacattttcatcgttgatcgcatcaaagaacttatcaaatacaagggctttcaggtggctccggcggagcttgaagctattctactcactcatccatcagttgaagacgtagccgtcgtgccgttaccggacgaggaagcgggagagattccggtggcttgtgttgtgatgaatccaaaagcgaaagagaaagaagaagacatccttagctttgttgcggcaaatgtggctcactacaagaagatcagagccgtccattttgtggattcaattcccaagtctctctctggtaaaatcatgaggaggcttctcagagacaacatcctcagcatcaagaaaacgctattctaagtggttgattaacggtttggttatccattaattagtcgcttaatttaatcttcttttattaagaatgttttactatcaacgttttcaacgtttctgatgtttaacggagtagacaaaactaataacacaccaagaacattctacctagtttgttagactagctccaattaatgtattaatctctaccagaaaatataaaacgagtccgtagaagggcaaatctcca

SEQ ID NO: 302 - DNA, 893 bp, Arabidopsis thaliana
aagggatttgtttttctcaaaatctctgaaagcttttggatatttgtgatcgcatagatcgattccttttgcggagaaatgcaattgattcgtggcagtacaaggttgcttcagaggcatcgtttctccatctccaacactcttcctttcacttcttcttcttgtggaagctggtctgctaatgaatcgaggaagctaggctttgattctttccctagtactagagctgcgacatatctcattagctcgttgaaaaatgccggcttttcctctttggcagtagtacctaaacaaaacttttcgtcgaggtgtttttccaccactggagattctgttcaaggatcccctgagtcagattgtgttgtgcctcagagaatcaagtttaagcggcttgataaaaccgctaagcatattatgcagattgtagacaaggaagcagttgaggaagtgagaactcttagagagattccagagataaagcctggttacattgtgcagctaaaagtggaagtgcctgagaacaagaggcgtgtatcaatcgtaaaaggcgtcgtcatagcaaggcgtaatgctggtctcaactcaacatttagaattagaaggcttgttgctggagtgggcgtcgaatccatgttccccttgtattccccaaacctgagggtgattaaggtggtggacaagaagaaagtaagaagagccaagctttattacctcagggaaaaggtcaatgctctcaagaagcattaacagccttaataagaattagcagtctactcttgtctttaagaattgaatttgtgtaatcgtgaatctcttcaattctcttgataagccaatcatcacaagcaggttaaattgatctttcatgagttcacctctctgtttttgtttct

SEQ ID NO: 303 - DNA, 1061 bp, Arabidopsis thaliana
tgtctcagactccgccaattctctggaaacttaatttggatattgttaatttgttctcgcatagatcgattcctcttacggagaaatgcaatcgattcgtagcagtacaaggttgcttcagaggcatcgtttctccatctccaacactcttcgtttcacttcttcttcttcttcttctggaagctggtctgaaaatgaatcgaggatggtaggatttgattctttcccttgtaccagagctgcgacatatctcattagctcgttgaaaaatgtcggtttttcctcttcggcgatacctaaacaagactttaagtattcgttgaggtgcttttctactaccggagattctgttcaatctactcctcaaggatcccctgagtcagattgtgttgtgcctcagagaatcaagtttaagcggcttgataaaaccgctaagcatataatgcagattgtagacaaggaggcagttgaggaagtgagaaatcttagagagattccagagataaagcctggttacattgttcagcttaaagtggaagtgcctgagaacaagaggcgtgtatcaatagtaaaaggcgttgtcatagcaaggcgtaatgctggtcttaactcaacatttagaattagaaggcttgtcgctggagtgggcgttgaatccatgttccccttgtattccccaaacctgagggagattaaggtggtggacaagaagaaagtaagaagagccaagctctattacctcagggacaaggtgaatgctctcaagaagcattaacaaccatataaaaagcaatctactcttatcttaaaacaattttcgaaggttttagttacactccctcaaaaggagacgatttggccttagtgtcacattgaattcgtgtaatgataatgaatctcttcagtcctcttgataactcgttagcatatcaatttatttttatctcaaagatataaatttataagtaaaacaaaatattttttctatccaacaagaaaaaataaagattttgaacgttagaaaattgtactaaactgttttataattattagtgttaaat

SEQ ID NO: 304 - DNA, 992 bp, Brassica napus
ggaagaagcgagggttttgtttgagctcaaactccgccaatctctgggccaaacttaacagatttgaaggcattagatcgtgtattcttgttggagaaaatgcaatcgatttgtagtagcagtacaaggttgcttcagaggaaccgtttctccatctccaacactcttcttcgtttcacttcgtcttcttctccaagctggtctgaaaatgaatcgaggaagctagcagggtctgatcctttccgttccaccagagctttcgattcatatctcatcagctcgttgacaaaggcggcttctttctcttccccagtacctaaacaatgctttacgtattcgtcgaggtgcttttcaaccattggagattctgttcctcaaggattccctgttgtgtcggctcctgatgtgcctccgagaatcaagttcaagcggcttgataaaaccgccaagcatatcatgcagattgtagacaacgaggctgttgaggaagtgagaactcgtagagagataccagagataaggcctgggtatattgtgcagcttaaagtggaagtgcctgagaacaagaggcgtgtttcaatcgtaaaaggcattgtcatagcgaggcgtaacgctggtcttaactccacttttaggattagaaggcttgttgctggagtcggtgtcgaatctatgtttcccttgtattcgccaaacctgagggagattaaggtgttggacaagaagagagtgagaagagccaaactttattacctcagggacaagatgaacgcgctcaagaagcattagcaccttcatcatcatatcataaaagaaagttgcctatactctcctggaaactaaagtcttgaggttttgtagtgacgatttgatcttaagccacatattggactgtataatgtattgaataatccataagctattgttccccacaaagcaaatgttgtgccatttttgaaacaacataaaaatttaatctcttttttttctac

SEQ ID NO: 305 - DNA, 965 bp, Raphanus sativus
ctcaaactccgctgtaaaaccttcagggcattattagatcgaatcctctctttgcgggagaaaaatgcaatcgattcgtagcagtacaaggttgctccagaggaaccgcttctccatctccaacactctccctcgtttcacttcttcgtcttcttcttctcaagctggtctgatgataatgaatcgaggaggctaggaggagggtttgattcattccgttccacaagagctttcgattcgccagcagcgtcctatctcattagctcgttgacaaaggcggcttctttctcttccgcactacctagacaaractttacgtattcatcgaggtgcttttccaccgttggrgagtctgttcctcaagggtttcctgtgtcagctcctgatgcgcctccaagaatyaagttcaagaggcttgataaaaccgccaagcatatcatgcagattgtagacaaggaggctgtggaggaagtgagaactagtagagagataccggagataaggcccggttacattgtgcagcttaaagtggaagtgcctgagaacaagaggcgtgtttcaatcgtaaaaggaattgtgatagcaaggcgtaatgctggtcttaactctacgtttaggattagaaggcttgtggctggagtgggagtcgaatccatgttccctttgtattctccaaacctgagggagattaaggtgttggacaagaagagggtaagaagagcgaaactctactacctcagggacaagatgaatgctctcaaaaagcattagcacctcaataatcatttaccaaaaaaaaaaaagagagagagagagaactctgtactcttaaacaaaatctttgagtgtttttctttaatgatgacttagcattgagtcatatattggactgtgtaatgttatgaataatgatggatccagcttttgatcaagaaaaagaaaagaaaaatggggtattttttcta

SEQ ID NO: 306 - DNA, 919 bp, Raphanus sativus
aggtttctcaaactccgctgtaaaaccttcagggcattattagatcgaatcctctctttgcgggagaaaaatgcaatcgattcgaagcactacaaggttgcttcagaggaaccgcttctccatctccaacactctccctcgtttcacttcttcgtcttcttctccaagctggtctgatgataatgagtcgaggaggccaggaggagggtttgattcattccgttccaccagagccttcgattcgccagcagcgtcgtatctcattagctcgttgacaaaggccgcttctttctcttccgcactacctaaacaaaactttacgtattcatcgagatgcttttccaccgttggagactctgttcctcaaggattttctcctgatgcgcctccaagaatcaagttcaagcggcttgacaaaaccgccaagcatatcatgcagattgtagacaaggaggcagttgaggaagtgagaactcgtagggagattccggagataaggcccggttacattgtgcagctgaaagtggaagtgcctgagaacaagagacgtgtttcaatcgttaaaggaattgtcatagcaaggcgtaatgctggtcttaactctacgttcaggattagaaggcttgtggctggagtgggagtcgaatccatgttccctttgtattctccaaacctgagggagattaaggttttggacaagaagagggttagaagagcgaaactctactacctcagggacaagatgaatgctctcaaaaagcattaactcctcaataatcatcaccaaaaaagagagagaaagagagagaactctgtactcttaaacaaaatcttgagtgttttttctttaatgatgacttagcattgagtcatatattggactgtgtaatgttacgaataatgatggatccagcttttg

SEQ ID NO: 307 - DNA, 1562 bp, Raphanus sativus
ggaggaaacattcatcattgtacccaacaatcactttcatcctttagaatcaaaaacttcagcttccttccttcttcttcttcctttcatttacatttacactcatacatatatacatacgacacgtatacatgcatacatacatactcccactctctatataaccttttgattctcctctttcccttttccctctcctccaatttcctcacttctctctctcttaagatctttacaatttgatcatcgaccgaccaaagaaagaaacaagttaaaaaatcagatctttctaacatggatccgtcctctgcaagctcagtgaacggatactactcatttctaaacagatcaatggatgatctcgagagggtttatctctcaaacaacttcatgtccctacacttcttacagagagctctctgtctcctccgcacctctcactcccatctcactctcctcgtccagaaactcaacctccccgtcggagacaaatggctcgatgagtatatggacgaaagctccaagctttgggaagcttgcctcgtcatcaagtccgccgtttcttccatcgagaacttctcctccgccggaatttcgatcgcctccaccctcgacggtcactatcaccaccgtcgcctctcccctcagctttctcgtcaggtgataagagcgatcacggggtgcaggagagaggcgattgggatagaggcggagaacagagcgttggtggagaatcgagttcaaagtttccgttttggtcggagcagacggcggcgacggtgatggagtcgtcgacgaagctgcagaacgtttcagtggtttccgcggcgtactgtacgcgacgaggaacatgagctcgcttctgctcatggttctgatgaacggtctcgtctactgtgttcccagcgacgcaacaacgctgtcgcaaacgcaaacgcagacgacgcagaatcaggtcggcggattcgccggagcgatggggcggttgcagcagagagttgcggctgaggtggggaggacggggatgaggaaggggatactgatgcatgagtacaggaggagcaaggcggcgttggaagagctgaaggcggagcttgagcggagaggaggaggaggaggaggggaaagcgaggaggagggagagagggagttgagagagagagtggagaatctgagagggtattttggtaatttgaggaacgggacagagagtatagtgtcgcaaatcgatgatttctttgatgaaattgttgaagggaggaaaaagcttttggatttctgcagccatagatgaaaatatcaaaagctgacatttttcagtttcataaagatggaaaaatcaagaaaaaaaaagaagaagaagaaaactgggtagactctaggctttcgacgaatcatttggtaggagttgttgtaagttgtgacacttttttatgaaaacaaaaatgttaattcgtcaatctgctctattttagtattttgatgtttatttttataattctagaaatggagtttattctctgaatcatagctaaagtaaatgtctgcttttcagttttggt

SEQ ID NO: 308 - DNA, 814 bp, Brassica napus
cgcacgcacaaccttcctctgcaactccatggagcctgcggtgacgacgacggcttcttcctctttcggtgggtctcctcgactcgccgccctggctcagcaactgcggatgtacaagccgccgccttcttcatcgttcgacgacgacgccgaggagatgcaggcggatcaggagagcgcagggaaggtggtatctcaggttgggtttcaggaatccatgactccggtaccgaaagatccygagaggttcagaccgaagcgagctgctgtgttgatctgtatcttcgaaggagaggagggtgatctacgcgtcatcctcactaagaggtcttccagattgtctactcactcgggagaagtttcactgccgggtggtaaagcggaggaggatgataaagatgatgggatgactgcaaccagagaggctgaggaagagattggattggacccttctcttgttgatattgtcacctctctcgaaccttttctgtcaaagcatctcctaagagtaatacctgtgataggaatcttgaaggacaaaaaatcattcaatccgaaaccaaaccctgcggaagtggaagctgtgtttgatgcacctttagaaatgttccttaaggatgagaacagaagatctgaagagagagagtggatgggagaaaagtatctgatccactactttgactaccgaacaggagacaaagattatacgatatggggtttaactgccgggattttgatcagagctgcatcygtgacttatcaaagaccacctgctttcatcgagcagtgccctaagtttaagtayccyaaaatg

SEQ ID NO: 309 - DNA, 1385 bp, Raphanus sativus
ttttttctgaaatcagattcttttctttttgatgtttttactccatcgcaggcttcctttacttgcacgcacaaccttcctctgcaattccatggagcctgcgttgaccgcgtcatcctctttcggtgggtcttctcgactcgccgccttggcccagcaactgcgcatgtacaagccaccgccttcttcwtcatckttcgaaaacgatgaygaggagacgcaggcggatcaggagagcgcagggaargtggtttctcaggttgggtttcaggaatccatgactccggttccgaaagatcctgagaggttcagaccgaagcgagcggctgtcttgatctgtatcttcgaaggagacgagggcgatcttcgcgtcatcctcactaagaggtcttccagattgtctactcactcgggagaagtttcactgccgggtggtaaggcggaggaggatgataaagatgatgggatgactgctaccagagaggccgaggaagagattggtttggacccttctcttgttgatgttgtcacttctctcgaaccttttctgtccaagcatctcctcagagtaatacctgtgataggaatcttgaaggacaaaaacacattcaatccaaaaccaaatcctgcggaagtggaagctgtgtttgatgcacctttggaaatgttcctcaaggatgagaacagaagatccgaagagagagagtggatgggagaaaagtatttgatccactactttgactaccgaacaggagataaagattatacgatatggggtttaactgccgggatcttgatcagagctgcttctgtgacttatcaaagaccacctgctttcaccgagcagtgccctaagtttaagtaccctaaaatggtagagaaacatacttgtatgccttaatgtggtcctagatttggtcttcttccagtagaagaccaaacaagaaaggcaataacactcccacgaaactgattatgtaccagtgaatgcagaactaggctacttacttatgtatatgcggacagctcttagttcatgtccagacgagacrtctcattgacawwttttccatgaatcttctatttatgaggagataagtggaggggtttatttgtaattattttgtaactttgtytaggctttatttttaagctgtgtgcttaattgtgatccagagagcagttggctggttctggttcaccctcagtcattgatttggaggacatctcagactcatcttcaaaaggctcattttctattgtaaaacttctgctaaaataaataaatttgtatccctaaacaaaatttgaaagcaaacttgtcttatgaaccttgtaataattttattactcgtagtgattgcatttttatctctagactagta

SEQ ID NO: 310 - DNA, 1793 bp, Raphanus sativus
gaggatctgatcattcgtctccccctttctctctcaattcaatttcaattgtttctttctttgtagcatcacactacttcatctctcgaacgtggaagtggagtaagtaaacgttggtctgctagtattggcttcaaaagaatcgtaggagagagattttacagacaaaaactcccagaaagttcttagatttcgatcttgattttcaaaatgggtctgtgtcattcagtagataggaaggaaccaggagaaacaagcaccaccaccgcctctacggctgaggatacactaggctccggacggtggcggcggccgagaggttacaagggcggcggcgaaatcgaagggacacaacaggtgttggatcggttgatctcgaatggttcaagtaaaagtgtatgtctttacacacagcaaggcaagaaaggaaccaatcaagacgctatgctcttttttgagaacttttgttcaagagacgatacagtgttttgtggtgtgttcgatggacacggaccatttggtcatatggtcgccaagaaagtccgagacacactgcccttcacactctcaacacagttgaaactagcatcagagtcagaacaaagcgtcttagcaaacgwggatgaagaagaagaagggyagagaaacgagtctgtwactactactactatggatgagcaatggtgtgagttgaatccaaacggtgaacagcttccmgagatgtayctgcctcttaaacaagccttgctcaagtcttgtcagcagatagataaagagcttaaaatgcaccctactatcgattgtttctgcagcggcacaacttcagtcactttgatcaaacagggcgaggacttggtggtcggaaacatcggtgactctagagccgttcttgccacaagagaccaagacaatgctttkgtcgctgtacaattaccatagacttaaaccagactgccaagtgaatcagcgagaatccaaaaatgtaaaggcagagtgtttgcgttgcaagatgagccwgaggtagctcgtgtatggctaccaaacagcgactcacctggtttagcaatggctcgagcttttggtgacttctgtctcaaagattacggtcttatctcggtccctgacatcaactaccgccgccttacagaaggagatgagttcattattcttgctagcgacggggtatgggatgtgttgtcaaacaaagaagctgtggacattgttgcttcagctcctagtcgaagcacagcagctagagctytagtggacacagckgttagatcatggagaatcaagtatccaacttccaaraacgatgactgtactgtagtctgcctctttctccaagattcaagcaatgtagtaaaggattcacacaaagaagagatgtagwsagtrtcagtatyagtaacaaggaggaggaggaggatgagattgtbcaggttaaagaggaaagtacacctaagagttgtgggattgagtcgaagatgatgacaatgacacttgctgaatgtatatcggttgcacaggatgatgaagagtggtctgctttggaagggttgactagggttaatagtttattgagcattccaaggttgttctctggtgagcttagatcaactagttggaggaaatggttgtgacttcttttatttrtttttttttacttgtgtgcttcttaagttaaaacctacacaaacaccacrcatcatcaccatgttctttgtttcatatccaactttttttttcttctycatgtagtgttgtttttttccttccagttttatttttca

SEQ ID NO: 311 - DNA, 2249 bp, Raphanus sativus
tttttgtgaaaacataaaaactctttggttgcttcaagatcctgaaaatctggtagaaaaaaatgctggaagttggaagttccaatgccctctttttccaaacaaacactacttgtaataatcttctccgcgagcttcagaaaatatgggttgaaattggtgagagtgaggctgagaaagacgggatgctgatggaattggagaaagaatgtcttcaaatctatcaaaaaaaagttgaggaggctgcaaattctaaggcaaggcttcatcagtctgttgcagctatagaagctgaagttgcctctttgatggctgctcttggagtgctaaacatcaactcccagataaaaatggataaaagctcaaaatcattgaaagaaaagcttgcagctgtaacccctcttgttgaggacttgaggattcagaaagaggagagaatgaagcagttttctgacctgaaggcccaaatcgagaagattagtggagagatttcaggatacagtgaacatctmarcaarggcatgatcagttccttgactcttgaagaacaagacttgactctcagaaaactcaacgagtatcaaacacatctccgcacgcttcaaaaggaaaagtctgatcgcctcaacaaagtcttgggttatgtcaacgaggtgcacacgctttgcggtgtcctaggagttgactttagtcaaacggtytgcgaggttcatccgagcttgcataggacagaccacgagcagtctacaaacattagtgatagcacattggaaggactggacaacatgattcaaaagctaaaaaccgaaagaagagctcgatttcaaaagctgaaggatgyagtggcttcgcttttcgagctatggaatctaatggacacaccacatgaagagagaactaaatttggaagagttacatatgttgtgagatcatctgaatctaacgtcactgagccaggcatcttatcagccgagacaattgaacaggtgtctacggaagtggagagtctgagtaaactgaaagctagcaaaatgaaggaactggtgatgaaacggaggtccgagttggaggatctttgcagactaactcacattcaacctgatacaagcacttcggctgagaaatcaagtgcactaatagattctgggttagtggaaccttcggagcttcttgcaaatatagaaatggaaataaacaagattaaagaggaagcacagagccgtaaagacatcatggacagaattgaccgttggctctctgcatgtgaagaggaaaactggttggaagaatataatctggatgagaaccgttatagtgctggaagaggtggacatgtaaaccttaagcgtgcagaacgagccagagttacaatcaataagatcccagcgatggttgacaatcttattaagaaaactctagtttgggaagaggaaacgcacaagtcatttctctatgatggtgttcggttggttaacatactagaagactacaagttaacaaggaaacaacaggaagaggaaaagaaaagataccgggaccaaaagaagaggcaagatctcctactaacccaaagggaatccatatatggatcaaaaccgagtccaagaagaagcagcagcttcaggaagcctagtggttacagcattagcaatgggaatggttcaatgcctcccacacctcgcagaagctcagtggggacaacaacacctgaccttcttctgaccccgagatcttactcgggtcatcatcgccaaaacgggtattttaaagaagttaggagactcgcttctactcccttaaactatgtggccatacaaaaggaagatactgcttctactacttacacatcgatctatagctctgagccagactcacctctccaaggctgactttgactctcctttgcactgagattcatgttagaagttggatatatgtatgtggttaaggatttgkgaagtaatctttaataatgacgttatcgtaaagaagaagtcagtgatggatgaagatgcagacttgtgaatacagaaaggtgacttgacttgtttaggggagatatggwgagacaatgagtataaaataaaactgtatctgtaactctttttaatcttkcagtgagaaaatactatttttgccgtgtgaaagtgcgtttgtgtgtgtacttatttgtgtatataaaatatacgtatttgttttgagatgtgatgctttgatatttttttggtgtggtttcagtaatacttttc

SEQ ID NO: 312 - DNA, 1946 bp, Arabidopsis thaliana
ggctatgaaaccaaatgatcaattccgtcggcgttgttagaaaggaagctgagaattgcaactgcttacaagttttttttgtgtctggtagtttcaaagtcgatagcgtagaagcaaagaagaaagaagaaaactttcgtgaaaccttgagggatatggcgaatagcaaatacgagtatgtgaaatcattcgaattggaggatgaagtcatgcttcctaacttgatggttgttcgaatcgatggtcgtgatttttctagattttctcaagttcatgagtttgagaagcctaatgatgaaacagccctcaatttgatgaattcatgttcagctgcggttttggaagagtttcctgacataatctttgcttatggatacagtgacgaatacagctttgtattcaagaaaacatcaagattctaccagagacgagccagtaagattttgtcgttggtagcttctttctttgctgcagtttatgtaacaaaatggaaagagttttttccccaaagaaaattattatatgctccgtccttcagttcaaaagttgtaagttgtgcatcagcagaggttcttcaggcttatctcgcgtggagacaacaggactgccacgccaacaatcagtatgacacttgtttctggatgttagttaaaagtggaaagagcgtaagtgaaacccaagagattctaaaggatacacaaaaacagcagaaaaatgagcttctctttcagaaatttggtatcaattacaagacgcttcctgaattgtttcgccaaggatcttgtcttttcaagaaaaaggtggaagaaactgtaaagcatgacgaaaatggcaatcctgtaaaaagattgaggagaaaggctgtttttgtacattcagagaatattgcaggaagaagcttttggaatgagcagccctctctatataatgatcttggccacttcacgaaagacattggaaaaattgaaccagattttattaggtcgtttcagtttgagaacaaattgttacctttaacttgggtcgtggttaggattgatggctgtcactttcacagattttctgacgttcatgaatttgagaagccaaatgatgagcaagctctgaaacttatgaattcatgtgcagtggctgttctcgaggagtttgaggatattcactttgcctatggtgtcagtgatgagtatagctttgttttgaagaaagaatctgagctctacaaaagacaatccagtaagataatatctgcagtcgcatccttctttacatccacatatgtgttacaatggggagaatttttccctcacaaagaattgaagtaccctccatcattcgatggacgagctgtatgctatccaacatacaatattctcttggattatctggcgtggagacaagttgactgccacatcaataatcagtacaatacatgtttctggatgcttgttaagtctggaaaaaacaaaactcaatcccaagattacttaaagggtacacaaacacgagagaaaaatgagctgcttagccgtcaatttggaattgagtacaactcattacctgtaatctttcgaatgggttcttcggttttccgtctaaaggaagctgagaatggagtagtttcagggaagaaactggaaggagaagtggtcgtggatcattgcaacatcatcgaacgctgtttctgggaagaacacctacacattcttagctactcataaacagctgcattttagtattttacttcacttgtaagactaatttattgcaaattcttaatctccaattagcacagctttacttcttttcaacatgtgttataccttagtttttcacatgtatgtcaaccattgttaagattttagaaaagttattggttttgtatgttaaatacatttgtggaagacgagagaagggagatagatagatatgtaaaacattaaattcac

SEQ ID NO: 313 - DNA, 1793 bp, Brassica napus
caatcatatgtcgtttctcagtgaggggttctatctgaattgcattgatatttttcctctgctcgctgtaactttctcgggaaaatttcacaccatccacgtttcacaacgaaagacatactggactccacttgtagagatatgcaaacatttagtcagctaggaccgtcggaggttttcttcatcgctagaagagacaacccctgtacgagggcacagctttggttcacgggaagactccctttccgacaagaatcatttgggtttcgyataaagaacagagtagagtacagcgcaagacccgtgcctccaaacctgattgcagcagagaaagaagaagcyaaagccgttctaaccctcttcttcaagaagcaaggtcttagcaacagcgtctccgttaggatcatcaacaaatccgatctcttcatcgaccatttagtctctaggctccactctgttcacaaagcccgttacctcgtaggaagagagcttaccacactcgagatacgagactctctcattccttacctcgaacagcttcatgaacaacacggcgatcttctctccgacctcgttgtcagcttccccgatccaccaccacctgctgaagatagacccctttcttcttcacctccagctrcacttgcaccgcctcgtggtctcackgattcagctgcagacastaagaarctaagagcagtgtctcgcgtcrgcgagctcgacacagaaggtgcrytacgtcckcaaacactctacctyctcgacctcggcttaaacctcgagcagatcaaaaccatcacccgcaagttcgcagcgtttccttactacagcctcgagggaaagatcaaaccggtcgtggagtttcttctggacctcggtatcccaaaatcagacatcccaacaatcctctgcaaaaggccgcagatctgcgggatcagcttaaccgataacctcaaaccgaccatggccttcttggagacgttaggcatcgataagaaccagtgggcgaagatcatttaccgtttccctgctatcttaacttacagccgacagaaacttatctccaccgttgacttcctaactcaaaccggtctctccgaagaacagattgggaagatcttgactcggtgtccgaacatcatgtcttacagcgtggaagacaagctacgtccgacaatggagtattttaagtcgctaaacgtcgacgttgcggttctccttcatcgatgtccacagacgtttggtttgagcatagagacgaacctgaagccagtgactgagttcttcctcgagaagggctattgtatagatgagattgggatcatgatctctagatacggagctttgtatactttcagcttgagggagaatctgatgccgaagtgggattactttcagacgatggattatcccaagtccgagctggtgaagtttccgcagtttttcgggtatagtctgcaggagaggatcaagccgagatatgagctggtgaagagaagtggagtgaggctgttgttgaatcaggttttgtccttgtccggagttgagttcgagaaagttgttaagaagaagatgatgaagaaacttttgtctgatcatcaaagtagtagcgagctcttgtgaagccttttttagtttagagcaataaagagagtttatgatccttaagtgataaaaaccaaatcgtaatatttattgttaagagcctcattattcagctgaarctcaagctatgatgatrtcattycgatttcaacctgaaactctatctayawtwratwgyrrmycarmsc

SEQ ID NO: 314 - DNA, 839 bp, Arabidopsis thaliana
agagcatgagaaactttaaagaaaaaacaaaaagaacaaaatttgttatctctctttcctctcattttgaccctcttcacttctttttgatccctaaatggaacacgagagcaagaacaaggtggatgggatggagatggagaaaggaaaaaaagagagtgggtcgagaaaaggacttgagttaacgatgagagttttggctttggtcctaacaatggtagctgcgacagtacttggtgttgcgaaacaaacaaaggttgtgcctataaagcttattcctactttacctcctcttaatgtctctacaaccgccaaagcctcttacttgtctgcttttgtgtacaacatttctgcaaacgcgatagcttgcggttacaccgcgatctcaatagtgattgtgatgatcagcaaaggcaaaagaagcaaaagtttgttgatggcggtcttgataggagatcttatgatggtggctttactgttttccagcactggagccgccggagcaatcgggctaatgggtaggcatgggaacaaacatgttatgtggaaaaaagtttgtggagtgtttggcaaattctgtaaccaagctgctgtttctgttgctatcactcttattgcttcagttgtgtttatgcttcttgttgttcttgatgctttgaaacttccttaatcttaagtacacgcaactttaaaccagaaaacacaaaataagttttttctcttaatttgcatgtttctatttcttgtcgttttttgtgttatgtaaagtcattatcatcaattatgtagttgtctatttgtttgtttttttaagttttaaatttcattgcctatctatg

SEQ ID NO: 315 - DNA, 694 bp, Brassica rapa
ggcgatggaacaagagcgcaagaacaatatgaaygggatggaaatggaaaaaggaaagagggagagtgggtcgagaaaaggtcttgaattaacgatgagagtgttggctttggttcttacaatggtggctgcaactgtacttggtgtcgcgaaacagacaaaggttgtgtctattaagcttattccaactttgcctcctcttgatgtctcgacaacagccaaagcttcttacttgtctgcctttgtgtacaacatttcggcaaacgctatagcttgcggttacgcagcaatctcgatagcggttctgatgatctgcaaaggcagaagaagcaaagggttgttaatggcggttttgataggagatcttgtaatggtgggtttgctattttctggcactggagccgccggtgcaatcgggctaatgggttcacaagggaataaacatgtgatgtggaagaaagtttgtaacgtctttggaaagttctgtcaccaagctgctgcttctgttgccatcactcttattgcttcaattgtgtttatgcttcttgttgttcttgatgctatgaagcttccttaaawttttaataccctaaaacaatgctttaatttgctgtttctgcttgtttcttgtcatttgttatgtgtaaagtcattatcaacaatcatgcaactgtctatttgcttttaatgtttc

SEQ ID NO: 316 - DNA, 1405 bp, Brassica napus
gatggcagtgtagtatataattcacatctccctactcacctcgagggcttgagaagttgggaaaagaccaccatttattactcctctctctctctctttctctcttctctttacacaaagtgagacgcaatggaacacgagcgcaagaacaatctgaatgggatggagatggaaaagggaaataaggagagtggttcgagaaaagggcttgagttaacgatgagagtgttggctttggttctatcactaacggctgcaacagtacttggtgtcgcaaaacagaccaaggttgtgtctataacgctgattccaactttgcctccacttgatgtgtccgcaacagccaaagcctcttacttgtctgcctttgtgttcaacatttcggcaaacgccatagcttgcggttacacagcgatctcaatagccattctgatggtcagcaaaggaagaagaagcaaaggcttgataatggcggtgttgataggtgatctagtgatgatggctttactattttccagcaccggagccgccggagcaatagggttgatgggtgtacaagggaacaagcatgtgatgtggaagaaagtgtgtaacgtttttggaaaattctgtcaccaaactgctgcttcggtggccatcactcttctcgctgcaattatgtttatggttcttgttgttcttgatgctatgaagcttccttagtgcaagtgatatttctgtttcttctgcagctcttccgcttcttgtcgtgttgtgttgtgtgaagtcattatcaacaatcatgtaattgtcaatttgcttttaatgctttttatraaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaactaaattcaatggtgtggccaaatttttacaacgtcctgactgttaaaaacccttatgggggggaagaaattctttaaaacaaaaaaacccttacggcagcacggcccctaccccaagagcgcccgcaaagatcaacatgcccaacagaagccccaccttgaatagcaaatgcaacccgtactggaaacgggaaaaaaacctcggccggtttccatcgatcaacccaccgtggcactaacccttgaaggcgcccgtacagaccgctcctccaaaaactcccccttaatatccgaaccaatcaaccggttttcccccattaaagtgtaaatctgggggccctctaaaaggcggggaatccctctttttggtccaaaattgccccaaaaaactccgaccgccccaaaagttcggaataaggtgcgacagcccagaaagcacgttataccc

SEQ ID NO: 317 - DNA, 766 bp, Brassica napus
tggttggggagtcctttctctctctctatatatctctttctctctttggagtgagacgtaatggaacaagagcgcaagaacaatatgaatgggatggaaattgaaaaaggaaagagggagagtgggtcaagaaaagttcttgaattaacaatgagagtgttggctttggttcttacaatggtggctgcaactgtacttggtgtcgcgaaacagacaaaggttgtgtctattaagcttattccaactctacctcctcttgatgtctcgacaacagccaaagcttcttacttgtctgcctttgtgtacaacatttcggcaaacgctatagcttgcggttacacagcaatctcgatagcggttctgatgatctgcaaaggcagaagaagcaaagggttgttaatggcggttttgataggagatctagtaatggtgggtttgctattttctggcactggagccgccggtgcaatcgggctaatgggttcacaagggaataaacatgtgatgtggaagaaagtttgtaacgtctttggaaagttctgtcaccaagctgctgcttctgttgccatcactcttcttgcttcaattgtgtttatgcttcttgttgttcttgatgctatgaagcttccttaaaatttaataccctaaaacgagtgctttaatttactgtttctgcttgtttcttctcgtttgttatgtgtaaagtcattatcaacaatcatgtaactgtctatttgcttttaatgtttagtcaaattgttttctt

SEQ ID NO: 318 - DNA, 733 bp, Brassica napus
atggaacaagagcgcaagaacaatatgaatgggatggaaatggaaaaaggaaagagggagagtgggtcgagaaaaggtcttgaattaacgatgagagtgttggctttggttcttacaatggtggctgcaactgtacttggtgtcgcgaaacagacaaaggttgtgtctattaagcttattccaactttgcctcctcttgatgtctcgacaacagccaaagcttcttacttgtctgcctttgtgtacaacatttcggcaaacgctatagcttgcggttacgcatcaatctcgatagcggttctgatgatctgcaaaggcagaagaagcaaagggttgttaatggcggttttgataggagatctagtaatggtgggtttgctattttctggcactggagccgccggtgcaatcgggctaatgggttcacaagggaataaacatgtgatgtggaagaaagtttgtaacgtctttggaaagttctgtcaccaagctgctgcttctgttgccatcactcttcttgcttcaattgtgtttatgcttcttgttgttcttgatgctatgaagcttccttaaatttttaataccctaaaacaatgctttaatttgctgtttctgcttgtttcttgtcgtttgttatgtgtaaagtaattataaacaatcatgcaactgtctatttgcttttaatgttttatcaaattgtattctttagtcaaaacgttttctacgggttacc

SEQ ID NO: 319 - DNA, 772 bp, Raphanus sativus
ttttttactcatttctctgtctctctgtctctctatctctctttttctcagagtgagacgcaatggaacaggagcgcaagaacaatatgaacgggatggaaatggaaaaaggaaagagggagagtgggtcgagaaaaggtcttgaattaacgatgagagtgttggctttggttcttacaatggtggctgcaacagtacttggtgtcgcaaaacaaacaaaggttgtgtctattaagcttattccaactttgcctcctcttgatgtctctacaacagccagagcttcttacttgtctgcctttgtgtacaacatttctgcaaacgctatagcttgcggttacgcagcaatctcgatagcggttctgatgatctgcaaaggcagaagaagcaaagggttgttagttgcggttttggtaggagatctagtaatggtgggtttgctattttctggcactggagccgccggtgcaatagggctaatgggttcacaagggaataaacatgtgatgtggaagaaagtttgtaacgtctttggaaagttctgtcaccaagctgctgcttctgttgccatcactcttcttgcttcaattgtctttatgcttcttgttgttcttgatgctatgaagcttccttaaaatttaataccctaaaaacgaatgctattgctgtttctaattgtttcttgtcgtttgtgatgtgtcatgtcattatcaacaatcatgtgtaattgtctatttgcttttaatgttttatcaaatcgtattctttagca

SEQ ID NO: 320 - DNA, 803 bp, Raphanus sativus
ggagtatatagttcacatctctcttgtcacctgagggcttcagaagttgggaaaagaccaccatttattattcctctctctctctttacacgaagtgagacgcaatggagcacgagcgcaagaacaatctgaatgggatggagatggaaaagggaaagaaggagagcggttcgagaaaagggcttgagttaacgatgagagtgttggcttgggttctaacactggcggctgcaacagtacttggtgtcgcaaaacagacaaaggttgtgtctataacgcttattccaactttgcctcctcttgatgtgcccgcaacagccaaagcctcttacttgtctgcstttgtgttcaacatttcggcaaacgctatagcttgcggttacacagcgatctcaatagtcattctgatgatcagcaaagaaagaagaagcaaaggcttgataatggcggtgttggtaggtgatctagtgatgatggctttgctattttccggcaccggagctgctggagcaatagggttgatgggtgtacaagggaacaaacatgtgatgtggaagaaagtgtgtaacgtttttggaaaattctgtcaccaaactgctgcttcggttgccatcactcttcttgctgcaatcgtgtttatggttcttgttgttcttgatgctatgaagcttccttaatgcaattgatatcttccttaatgcaattgatatttctgtttcttcttacagctcttctgcttcttgtcgtgttgtgtaaagtcattatcaacaatcatgtaattgtctatttgcttttagtgcttt

SEQ ID NO: 321 - DNA, 825 bp, Thellungiella halophila
gagcttgagaagttgggaaaagactaccatttattactcctctctctctttctcttttctcttatctcttttaacctttttttttttataagtgagagataattgaacaagaacgcaagaacaatatgaatgggatggaaatggaaaagggaaagaaggagagtggttcgaggaaaggtctcgaattaacgatgagagtgttggctttggttctaacattggtggctgcaacagtacttggtgtctcaaagcagacaaaggttgtgtctattaaggttattccaactttgcctcctcttgatgtctctacaaccgccaaatccacttacttgtctgcctttgtgtacaacatttctgcaaacgctatagcttgcggttacacagcgatctcgattgtgattctgataatcagtaaaggcagaagaagcaaaggcttgttaatggcggttttgctaggagatttagtgatggtggctttgctgttttccggcaccggagctgccggagcaattgggctaatgggtttaaaagggaacaaacatgtgatgtggaagaaagtttgcaatgtttttggaaagttctgtcaccaagctgctgcttcggttgccatcacttttctttctgcagttgtgtttatggttcttgttgttcttgatgctatgaagcttccttaaatttttaaaaagaaagaaatcgtttgctgtttgctgtttcttgtcgttttgtgttgtgtaaagtcattatcaacaatcatgtaactgtctatttgcttttgatgttgtttctttatcaatcttttttatggtgagtccacttattcgatcg

SEQ ID NO: 322 - DNA, 658 bp, Brassica oleracea
cttccttccaaaatattaaaagaacacacaaaagaatggcagcgctagcatcaaaccctcagatgttaacgagacaaggtcacagtagttacaagaaggaacaattctggaagaaagagagtttgagtttggagaagaagtgtgggttttgttgcgtgaaggtttacaattatgaaaagcttgggaggtcacaagtagagaaagagtggaggttagaagccttttggtcaaacgtatcacagcctgagactgtggagatggtacccattaacgatgttgatgagcttgaagctgttctctctgaggcacgcaacctctctcagcctatcatcatcgaatggatggcttcttggtgtaggaaatgtatttacttgaagcctaagttggagaaattagcagcggaatataataaccgaacaaagttttactacgtggatgtgaacaaggtgcctcaaaccttggtcaagcgtggcaacatttctaaaatgcccaccattcagttgtggaaggaaggggagatgcaagaggaagtgataggaggtcacaaaggatggcttgtaattgaagaagtcagagaactgatcacaaatatgtttgattctctttttttctcttcctcatcttttcggttaatttgtacagtaacttttaaattttg

SEQ ID NO: 323 - DNA, 815 bp, Brassica napus
gacatctcttctcaaaacaaaaataaaaataaaaataaaaatcttaaaattatgtcatttgaaaactttagaatatttcatcagatatctcttccttggaaaagattaaaagaacttacaaaagaatggcagctctagcatcaaaccctcagatgttaacgagacaaggtcacagtaattacaagaaggaacagttctggaggaaagagagtttgaatttggagaagaagtgtgggttttgttgtgtgaaggtttacaattatgaaaagcttgggaggtcacaagtagagaaggagtggaggttgaaagctttttggtcgaacgtatcacagcctgacacaattgagatggtacccattaacgacgttgatgagctcgaagctgttctctctgacgcacgcaacctctctcagcctatcatcattgaatggatggcttcttggtgtcggaaatgtatttacttgaagcctaagttggagaaattggcagcggaatataataacagaacaaagttttactacgtggatgtgaacaaggtgcctcaaaccttggtgaagcgtggcaacatttctaaaatgcccaccattcagttgtggaaggaaggggagatgcaagaggaagtaataggaggtcacaaaggatggcttgttattgaagaagtcagagaattgatcaacaaatatgtctaattctctttttttttctcttcctcatcttttctgttaatttgtacagtagcttttaaattttgcctttttgatmtttgagacagagagaatgagaacttaaattgataagctttgtattttgttttc

SEQ ID NO: 324 - DNA, 840 bp, Raphanus sativus
gatgtcatatgaaaagtttagaatatttcatcagatatctcttccttcgaaaagatttaaaaaaacacacacaaaagaatggcagctctagcatcaaaccctcagatgttaacgagacaaggtcacagtaattacaaaaaggaacaattctggaggaaagagagtttgaatacggagaagaagtgtgggtttttctgtgtgaaggtttacaatcatgaaaagcttgggaggtcacaagtagaaaaggagtggaggttaaaagctttttggtcaaacgtatcacagcctgagactgtggagatggtacccatcaatgacgttgatgagcttgaagctgttctctctgacgcacgcaacctctctcagcctatcatcatcgaatggatggcttcttggtgtcggaaatgtatttacttgaagcctaagttggagaaactggcagcggaatataataaccgaacgaagttttactacgtggatgtgaacaaagtccctcaaactttggtgaagcgtggcaacatctcgaaaatgcccaccattcagttgtggaaggaaggggagatgcaagaggaagtgataggaggtcacaaaggatggcttgttattgaagaagtcagagaattgatcaataaatatgtctgattctcttttttttttcttctcttcctcatcttttctgttaatttgtacagtagcttttaaattttgcattttttgatatttgagacatagagaatggagaaagagaactaaatatgataagctgtgtttttagttttcaacagtttgtttgcgaatagatgacatacaagacagtaagacgcataagatatttaatca

SEQ ID NO: 325 - DNA, 748 bp, Thellungiella halophila
gatgtcacatgaaaactttgaaatatctcatcatatatcttcttctttgaaaaagaaaaagaaatggcagctctggcatcaaaccctcaaatgctaacgagacaaggtcacagtaattacaagaaggaacaattttggaggaaagagagtttgagtttggagaagaagtgtgggttttgtgtgaaggtttacagtgagaagcttgggagatcacaaatagagaaagagtggagattaaaagccttctggtcaaacgtatcacggcctgagactgtggagatggaacccattaacgacgttgatgagctcgatgctgttctttctcacgcacgcaacctctctcagcctatcatcatcgagtggatggcttcttggtgccggaaatgtatttacttgaagcctaagctggagaaattggcagcagaatataataaccgaacaaagttttactacgtggatgtgaacaaggtccctcaaaccttggtgaagcgtggcaacatttcgaaaatgcccaccattcagttatggaaggaagatgagatgaaagaggaagtgataggaggtcacaaaggatggcttgttattgaagaagtccgagaattgatcaacaaatatgtttgattctttttttttatttagctgtacagtcgtttttatttcccttttgttatatattagacattgagaatggagaaagagattttgttaaaacagaactaaaaattgatttaagttttattttagcttc

SEQ ID NO: 326 - DNA, 2026 bp, Brassica napus
gaacccaccaccgtcgtctagatatcaatctaacggagctaattcaattattccaatccctcgtttcaattcgaagccctaacaaaaaatccctaattgacgaaatcgccgaatcgttgatgaggatggagtttgacgaatacgagtacctggagaagacggtagaggaaggagatggattggataggaagaaggaagagagcgagaggagttacaggaagagggaaggagagaggcgtgacgttgaagaaggtgacgaagagcgaaggagcagtcggagtaagaagtctcgtggagacggcgaagagaacggtgaaggtaggagaagggatcgggagaaagagaggcataggagcagccgagacaaggaaagagaaagagagagggataagattagggttaggggaggatcgagagatagagagagcgatcgtgagaggagtagcaaagagagagataggggcgataggggcaaaagccgagagagagagaggragaaggatagagagaggagaagcaaagagagrgagaggagaagcagcagtagatcacggagggaagagaaggaacgcgaagtagttgaaagaggaagcaggagaaacaaggacaagaaagatgagcctgaagctgatccagagagagaccaaagaactgtttttgcatatcagatgcctcttaaagctaccgagagagatgtttatgagttcttctccaaagctggcaaggttagggacgtgaggctgattatggatagaaattcaagacgatcaaaaggagtcgggtatgttgagttttatgatgtgatgtctgttccaatggccatagctatgtctggacatwtgtttcttggrcarcctgtgatggttaagccctctgaagctgaaaagaatcttgcgcaatccaatgccactacaggcgttgtaggtggttctgggccttctggccctgttgatcgaaagctctatgtggggaacttgcattacaacatgacagagttgcaacttagacagatttttgagcaatttggtcctattgagcttgttcagatgccatatgaccttgtaagtggtcagtgcaaaggttatggattcatccagtttgcycaatttgaacattcaaaggcagcacaaactgccttaaacggacaattagagattgctggtagaacaatcaaggtttcgtttgtctctgagcatataggcacacaagacgctaatccaaaatcagctgattttgatgatgatgatggaaatgggctggctttaaatgcacaaacgagggttcagctcatgcagaagctggatcgtacaggtgtcgcagcaaacattgtgggaccttttggagtaccagcgctaaatggaacagctctkaatcaaccaggcatgaatcctggtttccccacatcagtgcttccgacaacagcyatccctgcttttgtcacagagcctrttggtcarccaagtcaatgycttctattgaaraacatgtttgatcctgcaaccgagacggaattggattttgatgaagaaattaaagacgacgttggtcaagaatgctccaagtatgggcaggtcaaccatatttatgtagacaagaagagcgcaggttttgtgtatctgcggtttgaatcggtgcaggctgcmgcggcagctcaaagagcaatgcacatgagatggtttgcrcaaaagatgatatctgcaactttcatgcctccaaatgaatatgaagccaaagccaaggcgtgaagtgcaggcaagatagatttacttgttcagactcggtataaaacctaaaccggactgcgatccatattcagtctcctgtctgaaacatgttttatatataaatcaaaagactattggagacctttccttccgttcttggttgttcgttttagccgtaacattcccatatcatttatcrtaaacttattttatcttatttcaacagtgttactatttgtttacagttttgaaattgacttggtgtttctaaacgatgatatgagatcgtaaagatttttact

SEQ ID NO: 327 - DNA, 877 bp, Brassica juncea
  misc_feature (855)..(855): n is a, c, g, or t
ggcctcgatcaaacacactcagttcatcagacaatgtggagcgtcaccggagcattgggcgtggcggtgcctaccgccgccgcttgccgtccaaaaccctttattacctcctctaaccttcttcccaagcagacgaagaagctccatctctctccgcagcagcagcctctgtctctagcatcacaattctcctcctcctctttcagaacagctgcttcttccgttgaacaacagtctgataataagggagagagcactaagtattacttcctagtagcgaacgccaagttcatgcttgacgaagaggaacactttcaggagcaactgtttgaacgtcttcgatactacggagagaatgacaaagagctagacttctggctcgtcatcgagcctaagttccttgacaagttccccaagatcactcagaggctccgtcgccctgccgtcgctcttgtctccaccaatggtccctggatcacatttatgaagttaagattggatcgagttcttgctgattcctttgaagctacctctcttgatgaagccttggcctttactcctaccactcttgagttcgataagcctaagaattgggtggcgccgtaccccaagtatgaacctggatggtgggaaactttcttgcccaaagcaaaacaagaatctgtagcatagtgctttgtcctttttttttttcattgtcggaatccatctttgtcttaagagtgctttctagtttatattactgagcttcttgtatttccgtgtactacaaatatgttgcaactcagttgagtctagtgaccagaatcgatcaaggggctgtttctatttggctagctgcactgttttttttancatcaagagtcttatgtaactt

SEQ ID NO: 328 - DNA, 717 bp, Brassica oleracea
gacagattcttctcgatcaaagttaaaacactctaatcagctatgtggagcgtcaccggagcattgtgcgtggcggtgcctaccgccgccgcattccgtcctaaaccatttcttgtatcctctaaccttcttcccaatcagacgaagaagctccatctctctcctccgcagcctccggctctatcatcgcatttctcctcctcttctttcaaaaccgccgctacttccgttcaacaacagtcagatgataaaaagggagagaagagcaccaagtactacttccttgttgcaaacgccaagttcatgcttgacgaagaggaacacttccaggaacagctgtttgaacgtttgaaatactacggagagcgtgacaaggagaaagacttctggctcgtcattgagcctaagttcctcgacaagttccccaaactcactcagagacttcgtcgccctgctgttgctcttgtttccaccaatggcccctggatcacgtttatgaagctgagattggatcgagttctagctgattcctttgaagctgcctctctggatgaagccttggcctctagtcccaccactctagagttcgaccagcctggaaattgggtggcgccatacccaaagtatgaacctggatggkgggacaccttcttgcccaaagcaaaacaagagtctgtagcataaaacttgtccagctttgtcttagtgctttctatt

SEQ ID NO: 329 - DNA, 871 bp, Brassica oleracea
ggagatgagagatgagagataaaaagataagatttttccagattcctctgcctcgatcaaacactcagttcagagaaaatgtggagcgtcaccggagcactaggcgttgcggtgcctaccgccgccgcttgccgtccgaagcaccttctcacctcctctaaccttctacccaagcagacgaagaagctacatctctatccacagcagcctctgtctctagcatcacatttctcctcctctttcagaacagctgcttcttccgttgaacaacagtctgacaataagggagagagcactaagtactacttcgtggttgccaacgccaagttcatgcttgacgaagaggaacactttcaggagcagttgtttgaacgtcttcgatactacggagagaatgagaaagagctagacttctggctcgtcattgagcccaagttcctcgacaagttccccaagatcactcaaaggctccgtcgccctgccgtcgctcttgtctccaccaatggaccctggatcacgtttatgaagttaaggttggatcgagtgcttgctgattcctttgaagcgacctctcttgatgaagccttggcctttactcctaccactcttgagttcgataagcctaagaattgggtggcgccataccccaagtatgaacctggatggtgggaaaccttcttgcccaaaataaaacaagaatctgtagcatagtactttgtcctttcttttttttcattgtcggaatccatctttgtctaagagtgctttctagtgtgtattactgagcttcttgtatttctgtgtactacaaatatgttgcaactcagttgaatctagtgaccagaatcaatcaaaggcagtttcacatatt

SEQ ID NO: 330 - DNA, 872 bp, Brassica rapa
gagagataaaaagataagatttttccagattcctctgcctcgatcaaacacactcagttcatcagacaatgtggagcgtcaccggagcattgggcgtggcggtgcctaccgccgccgcttgccgtacgaaaccattactcgtctcatccaaccttcttcccaagcagacgaagaagctccatctctctccgcagcagcagcctctgtctctagcatcacaattctcctcctcctctttcagaacagctgccacctccgttgaacaacagtctgataataagggagagagcactaagtactacttcctggttgcgaacgccaagttcatgcttgacgaagaggaacactttcaggagcagttgtttgagcgtcttcgatactacggagagaatgagaaagagctagacttctggcttgtcatcgagcctaagttcctcgacaagttcccaaagatcactcaaaggctccgtcgccctgccgtcgctcttgtttccaccaatggtccctggatcacgtttatgaagttaaggttggatcgagttctagccgattcctttgaagcgacctctcttgatgaagccttggccttcactccaaccactctagagttcgataagcctaagaattgggtggcgccgtaccccaagtatgaacctgggtggtgggaaaccttcttgcctaaagcaaaacaagaatcagtagcatagtactttgtcctttttttttgtcattgtcggaaatccatctttgtcttaagagtgctttctagtgtgtattactgagcttcttgtatttctgtgtactacaaatatgttgcaattcagttgagtctagtgaccagagtcgatcaaggggctggtttctatttggct

SEQ ID NO: 331 - DNA, 873 bp, Brassica napus
gcctcgatcaaacactcagttcagagaaaatgtggagcgtcaccggagcactaggcgtggtggtgcctaccgccgccgcttgccgtccgaagcaccttctcacctcctctaaccttctacccaagcagacgaagaagctacatctctatccacagcagcctctgtctctagcatcacatttctcctcctctttcagaacagctgcttcttccgttgaacaacagtctgacaataagggagagagcactaagtactacttcgtggttgccaacgccaagttcatgcttgacgaagaggaacactttcaggagcagttgtttgaacgtcttcgatactacggagagaatgagaaagagctagacttctggctcgtcattgagcccaagttcctcgacaagttccccaagatcactcaaaggctccgtcgccctgccgtcgctcttgtctccaccaatggaccctggatcacgtttatgaagttaaggttggatcgagtgcttgctgattcctttgaagcgacctctcttgatgaagccttggcctttactcctaccactcttgagttcgataagcctaagaattgggtggcgccataccccaagtatgaacctggatggtgggaaaccttcttgcccaaaataaaacaagaatctgtagcatagtactttgtcctttcttttttttcattgtcggaatccatctttgtctaagagtgctttctagtgtgtattactgagcttcttgtatttctgtgtactacaaatatgttgcaactcagttgaatctagtgaccagaatcaatcaaagggcttgtttctatttggctagctgcactgtttttttttttatcaatcaagagtcttatgtcttcct

SEQ ID NO: 332 - DNA, 841 bp, Brassica napus
gatcaaagtcaaaacactctaatcagctatgtggagcgtcaccggagcattgtccgtggcggtgcctaccgccgccgcattccgtcctaaaccatttcttgtatcctctaaccttcttcccaatcagacgaagaagctccatctctctcctccgcagactccagctctatcatcgcatttctcctcctcttctttcaaaaccgccgctacttccgttcaacaacagtcagatgataaaaagggagagaagagcactaagtactacttccttgttgcaaacgccaagttcatgcttgacgaagaggagcacttccaggagcagctgtttgaacgtttgagatactacggagagcgtgacaaggagcaagacttctggctcgtcgttgagcctaagttcctcgacaagttccccaaactcactcagagacttcgtcgccctgctgttgctcttgtttccaccaatggcccctggatcacgtttatgaagctgagattggatcgagttctagctgattcctttgaagctgcctctctggatgaagccttggactctagtcccaccactctagagttcgaccagcctggaaattgggtggcgccatacccaaagtatgaacctggatggtgggacaccttcttgcccaaagcaaaacaagagtctgtagcataaaactttgtccagctttgtcttagtgctttctattttgtattactgagcttttgttattatccgtgtgctccaagtatgtttgcaactcagttgagtctagtgcacagaattgatcaaggtctatttctacttgcacatgtttctgatcaatcaagcttctatctcttgacc

SEQ ID NO: 333 - DNA, 783 bp, Brassica napus
ggaggatgatgagagataaaaagataagatttttccagattcctctgcctcgatcaaacacactcagttcatcagacaatgtggagcgtcaccggagcattgggcgtggcggtgcctaccgccgccgcttgccgtccaaaaccctttattacctcctctaaccttcttcccaagcagacgaagaagctccatctctctccgcagcagcagcctctgtctctagcatcacaattctcctcctcctctttcagaacagctgcttcttccgttgaacaacagtctgataataagggagagagcactaagtattacttcctagtagcgaacgccaagttcatgcttgacgaagaggaacactttcaggagcagttgtttgagcgtcttcgatactacggagagaatgagaaagagctagacttctggctcgtcattgagcctaagttccttgaaaagttccccaagatcactcagaggctccgtcgccctgccgtcgctcttgtttccaccaatggtccctggatcacgtttatgaagttaaggttggatcgagttctagctgattcatttgaagctacctctcttgatgaagccttggctttcactcctaccactcttgagttcgataagcctaagaattgggtggcgccgtaccccaagtatgaacctgggtggtgggaaaccttcttgcctaaagcaaaacaagaatctgtagcatagtactttgtccttctttttttttgtcattgtcggaaatacatctttgtctgagagtgctttctagtg

SEQ ID NO: 334 - DNA, 834 bp, Raphanus sativus
gattcctctgcctcgatcaaaacacactcagttcagaaaatgtggagcgtcaccggagcgttgggtgtggcggtgccaaccgccgccgcttgccgtacgaaaccgttactcttctcctctactcttcttcccaagcagacaaataagctccatctctctcctcagcagcagcagcctctgtctctatcctcacatttctcctcctcctctttcataacagctgccacctcctccgttgaacaacagtctgataataagggagttagcagcaagtactacttcctggtagcgaacgccaagttcatgcttgacgaagaggaacactttcaggagcaattgttcgagcgtcttcgttactacggagagaatgaaaaggagctagacttctggctcgtcatcgagcctaagttcctcgacaagttccccaagatcactcaaaggctccgtcgccctgccgtcgctcttgtctccaccaatggtccctggatcacgttcatgaagttaaggttggatcgagttctagctgattcctttgaagctacctctcttgatgaagccttggccttcactcctactactttagagttcgacaagcctaagaattgggtggcgccataccccaagtatgaaccgggatggtgggaaaccttcttgcccaaagcaaaacaagaatctctagcatagtagtacttttttttgtcattgttgtccgaatccaacagctttgtcttagagtgcttttcttgttttgtattactgagcttcttgtatttcctgtgtactacaaaatatgttgcaactcagttgtgaccagaatcgatcaaaatctgtttc

SEQ ID NO: 335 - DNA, 874 bp, Raphanus sativus
ttttttcagattcctccgagtctatttgttgcatacaagctgctttggtctcactcctagatcaaaacacactaagttcagaaaatgtggagcgtcaccggagcattgggcgtggcggtgccaaccgccgccgcttgccgtacgaaaccgttactcgtctcctctactcttcttcccaagcagacgaataagctccatctctctccgcagcagcagcctctgtctctatcctcacatctctcctctttcataaccgctgccacctccgttgaacaacagtctgataataagggagagagcagtaagtactacttcctggttgcgaacgccaagttcatgcttgacgaagaggaacactttcaggagcaattgttcgagcgtcttcgttactacggagagaatgaaaaggagctagacttctggctcgtcatcgagcctaagttcctcgacaagttccccaacatcactcaaaggctccgtcgccctgccgtcgctcttgtctccaccaatggtccctggatcacgttcatgaagttaaggttggatcgagttctagctgattcctttgaagctacctctcttgatgaagccttggccttcactcctacttctttagagttcgacaagcctaagaattgggtggcgccgtaccccaagtatgaaccgggatggtgggaaaccttcttgcccaaagcaaaacaagaatctctagcatagtagtactttttttgtcattgttgtccgaatccaacagctttgtcttagagtgcttttcttgttttgtattactgagcttcttgtatttcctgtgtactacaaaatatgttgcaactcagttgtgaccagaatcgatcaaaatctgtttctacttggc

SEQ ID NO: 336 - DNA, 884 bp, Raphanus sativus
gattcctctgcctcgatcaaacacactactcagttcagaaaatgtggagcgtcaccggagcatttggcgtggtagcggtgccaaccgccgycgcttgccgtacgaaaccgttactcgtctcctctactcttcttcccaagcagacgaataagctccatctctctcmgcagcctctgtctctatcctcacatttctcctcctcctctttcataacmgctgccacctccgttgaacaacagtctgataataagggagagagcagcagcaagtaytacttcctggttgcgaacgcaaagttcatgcttgacgaagaggaacactttcaggagcaattgttcgagcgtcttcgttactacggagagaatgaaaaggagctagacttctggctcgtcatcgagcctaagttcctcgacaagttccccaacatcactcaaaggctccgtcgccctgccgtcgctcttgtctccaccaatggtccctggatcacgttcatgaagttaaggttggatcgagttctagctgattcctttgaagctacctctcttgatgaagccttggccttcactcctactactttagagttcgacaagcctaagaattgggtggcgccctaccccaagtatgaaccgggatggtgggaaaccttcttgcccaaagcaaaacaagaatctctagcatagtagtactctttttttttgtcattgtttgtccgaatccaacagcctttgtcttagagtgcttttcttgttttgtattactgagcttcttgtatttcctgtgtacttgcaactcagttgagtctagtgaccagaatcgatcaaaatctgtttctacttggcaaagtgcacatgtttttgatcaatcaagagttctgatttcttcct

SEQ ID NO: 337 - DNA, 918 bp, Raphanus sativus
gatttctctgcctcgatcaaaacacactcagttcagaaaatgtggagcgtcaccggagcgttgggtgtggcggtgccaacggccgccgcttgccgtacgaaaccgttactcgtctcctctactcttcttcccaagcagacgaataagctccatctctctccgcaacagcagcagcctctgtctctatcctcacatttctcctcctcctctttcataaccgctgccacctccgttgaacaacagtctgataataagggagagagcagtaagtactacttcctggttgcgaacgcaaagttcatgcttgacgaagaggaacactttcaggagcaattgttcgagcgtcttcgttactacggagagaatgaaaaggagctagacttctggctcgtcatcgagcctaagttcctcgacaagttccccaacatcactcaaaggctccgtcgccctgccgtcgctcttgtctccaccaatggtccctggatcacgttcatgaagttaaggttggatcgagttctagctgattcctttgaagctacctctcttgatgaagccttggccttcactcctactactttagagttcgacaagcctaagaattgggtggcgccataccccaagtatgaaccgggatggtgggaaaccttcttgcccaaagcaaaacaagaatctctagcatagtagtacttttttgtcattgtccggatccaacagctttgtcttagagtgcttttcttgttttgtattactactgagcttcttgtatttcctgtgtactacaaatatgttgcaactcagttgagtctagtgaccagaatcgatcaaaatctgtttctacttggcaaaagtgcacatgtttttgatcaatcaagagttctgatttcttcctcttgatcagagttttgtacaaaaaaaaaa

SEQ ID NO: 338 - DNA, 921 bp, Thellungiella halophila
  misc_feature (105)..(105): n is a, c, g, or t
ggatgataatggatcacccccggcaaaaaagataagatttttgcagattccgcctcgatcaaaagactcaaaaatcagcaatgtggagcgtcaccggagctttgnggtgtggcggtgcctaccaccgccgcttgccgtcggaaaccctttctcgtctcctcttcgcttcccaagcagacgacgaaactccatctctcatcgccgcagttaactcttccatcatcacatttctcgtcgtctttcaaaacctctgccaccacctccgtacaacaacagtcggataataagggagagaggaccaagtactacttcctggttgcgaacgccaaattcatgcttgacgaagaggaacacttccaggagcaattgtttgaacgtcttcgatactacggagagcgtgaaaaggagcaagacttctggcttgtcattgagcccaaattccttgataagttccccaaaatcactcagagacttcgtcgtcctgccgtagctcttgtttccaccaatggcccatggatcacgtttatgaagttaagattggatcgtgttttagctgaatccttcgaagctaagtctcttgatgaagccttggcttccaatcctgcaactctagagttcgatcagcctgaaaagtgggtggcgccataccccaagtatgaatctggatggtgggaaactttcttgcctaaagaaatccaagaatctgtagtatagaacattgcctttttgtctatttttgtattctccaaatccagctttgtcttagtgctttctagcttgtattactgagcttcttatatttctgtgtactccaaatatgttgcaactcgttgagtctagtgagcaaaattgatcaaggcctatttctactttgtaagttgcacatatttctgatcaatcaagggttctgtgttctaccag

SEQ ID NO: 339 - DNA, 1773 bp, Arabidopsis thaliana
gtccaagtgcttgacccatacctctctgttcttcctctctctcttcccccaccacagtcaccactttactcttctccatcaggggtccgatcccatctccaattttaaaccctagaaatcaatctcaaaagcaagcgtgcttcattaatggcgagcttcattctctccaggtcattactcgttctactcctgtctctcaccgcattactctccagcatctcgatttcggaagctacctcatcgttctcgttcacaagctccggtaaaaatgcgagctttgagtccgaagactttgccctgtacggcgacgctaagctcgtcgacggcggatcttcgattcagctgactgactcagtgagtcacggtggtgggcgagtcatctataagaaacccattgagtccatgaacaatataaaattcgagtatttcaccggattctctactttcttctctttctcgatttctcctagtcgtggtgggagactcggatttgtagtgtttcctgttaatgaaacgtttgatcactctttattccaagtaaagttcgatacttttgacagtttcacccaaattggagattctaatgtcgcggtgattgttgatggtgctacggtgtctgagaggattcgcaatttcacgatcgcaaacttggagaagacggagaaggttttgttgtacgcttggattaattaccaagctggtggcaagttcttagaagtccggttaagtaaatctaaaagctttgaatctgttcttcctctgatgtttgatcagattgatttgtcacaaatgttgagagatgaggatgagttcatggttgctgtgaattcgtatagtgggaatgtaaatcttcattcttggagtttagaagtgagacactccgagtatgagcactcttgggcgccggtgcttttggaggaacaacttagaaaagaggaacaacttagaaaagaggaggctgcgaagaagaggacaagtgataggatgtgggaggttgtcacttgcttcgtcatgacctttggatcaacagggcttgtgttctttgccatgatgcatatatatgcagctttcaaaaggaacaatcttgcgatggtgatgcaggaggaatgtgggatcaagaccaaggagtttgggtataagaagatggagaaaatggaagttgtgacgagtaatgctgatgcgaaacaagaaaggaagtgaagtcatgtttggtgatttttgtgtgtttaggatatgtgaactgttaatgtagtcaagtagattcttggtaactagttatccacgaggttcttcactggctaatgtaaccccttcttattttcatgtgtgtaagcttgcaaccttgttaccatttggcattttagtttgatttggcatgtaaaaatatgagaagaatgttgtagaatgcacaccaaacttgagtgcgagggatgacaaaaacaaattccaactcctacacaaaatagatttgtaactaatcacaatcatttgaagaacgcaatgtagtttatcttcatctacacaaaatcttcaaccggagataagcttcaagacgatgactgctgtgttaatgagcatgaggggtagcctcatgtactggcaggcatggatcagaccaatgatttggcctttgggagagtttcttctatcggtttggtggagttctccgagtgtccatcctcttggaacaaggaaacggtcttcgttgaggattgccagtgcatttgcaaagagcagcagaccttttaacaatgtccagaagcccattctttt

SEQ ID NO: 340 - DNA, 533 bp, Arabidopsis thaliana
aattttctaaagaagaaacaaattaaacctcaccgacggattcaattctctcgttctcaggccgtcttcatcgccggagcgttttcttacgaaaagaatgggcttctggacattgttaaaaggtctgctgctctttgcaaatgcactggcaatcctcaacgaagaccgtttccttgttccaagaggatggacactcggagaactccaccaaaccgatagaagaaactctcccaaaggccaaatcattggtctgatccatgcctgccagtacatgaggctacccctcatgctcattaacacagcagtcatcgtcttgaagcttatctccggttgaagattttgtgtagatgaagataaactacattgcgttcttcaaatgattgtgattagttacaaatctattttgtgtaggagttggaatttgtttttgtcatccctcgcactcaagtttggtgtgcattctacaacattcttctcatatttttacatgccaaatcaaactaaaatgccaaatggtaacaaggttgcaagct

SEQ ID NO: 341 - DNA, 418 bp, Brassica juncea
  misc_feature (405)..(405): n is a, c, g, or t
  misc_feature (417)..(417): n is a, c, g, or t
gatcttcaacgagatctctccaacacttcaacctccattcgattcacctagagacatcatgggattctggacactaatggaagggttgctgctatttgcaaacgcactagctatcctcaacgaagaccgtttcctagctccaaaaggatggacactcgcggagctacaccaaaccggcaaaagaaactctctcaaaggccaaatcgttggtctcatccacgcttgccagtacatgaggctccccctcatgctctttaacttaattgtcatcgtcgttaagcttttctccggttaaacacacacaagtcagaacaagcactttgttgtttatgcctcgataaaaatttaaatcaaaagtttgcgttgtatacattattgttcttgttatttattcaactacaaacncaaagtggaacng

SEQ ID NO: 342 - DNA, 217 bp, Brassica juncea
atcatcatgggattctggacactgatggaagggttgctgctattcgcaaacgcacttgccatcctcaacgaagaccgtttcttagctcccaaaggatggacactcgcggagcttcaccaaaccggcaaaagaaactccctcaaaggccaaatcgtcggtctcatccacgcctgccagtacatgcggcttcccctcatgctcttcaacttgattgtca

SEQ ID NO: 343 - DNA, 400 bp, Brassica oleracea
gagggttcgtcatcttcaacgagatctctccgacacttcaacctccattcgattaacccagagaaaccatgggattctggacgctaatggaagggttgctgctattcgcaaacgcactagctatcctcaacgaagaccgtttcctagctccaaaaggatggaccctcgcggagctacaccaaaccggcaaaagaaactctctcaaaggccaaatcgttggtctcatccacgcttgccagtacatgaggctccccctcatgctctttaacttaattgtcatcgtcgttaagcttttctccggttaaaaacacactagtttttcttttcttttttgttgacccttgtcagaacaaatgacttttgttgttgaaatttaaaaatcaaaagctcgcatttgtgt

SEQ ID NO: 344 - DNA, 409 bp, Brassica oleracea
gctcgacgccgtggatttcgacacacatataaatcatcatggggttctggacgctaatggaagggttactgctattcgccaacgcactagctatccccaacgaagaccgtttcttagctcccagaggatggacactcacagagcttcaccaaaccggcaaaagaaactccctcaaaggccaaatcgtcggtctcatccacgcctgccactacatgaggcttcctctcatgctcttcaacttaatcgtcatcgtttttaagctcttctccggttaaaaacaaaataaaattagattctaataattcaacccaaacacacttctcttcttttttttttttgttcacccttgtcggaacaagaactttgttcgttgattcattaaaattcaaaacctggcattgtatacatt

SEQ ID NO: 345 - DNA, 664 bp, Brassica rapa
ggattctcgacgccgtggatttcaacacacatagaaatacatcatggggttctggacactgatggaagggttgttgctattcgcaaacgcactcgctatcctcaacgaagaccgtttcttagcaccaagaggatggacactcacggagcttcaccaaacaggcaaaagaaactccctcaaaggccaaatcgttggtctcatccacgcctgccactacatgaggctccctctcatgctcttcaacttaatcgtcatcgtttttaagctcttctccggttaataacaaaataaaattagattctaataattcaaccyaaacacactttctcttctttytttttgttaacccttgtcggaacaagtactttgtcgttmattcattaaaagagaattttagggtttggggagactccgaagagattggcgtaacacttctgtctttgaacgcttatcttcctcgtcatgstkkytacttccgctacgtcgtcgttttttcatgttccatcttcctcctcgcttgatactaatgggaaggggaacagagttgggtctactaattttgctggacttaactcaacgccaagctctgggaggatgaaggttaagccaaacgctcaggctccacccaagatcaacgggaagaaagctaacttgcctggttctg

SEQ ID NO: 346 - DNA, 410 bp, Brassica napus
aggggcagggttcgtcatcttcaacgagatctctccgacacttcaacctccattcgattaacccagagaaaccatgggattctggacgctaatggaagggttgctgctattcgcaaacgcactagctatcctcaacgaagaccgtttcctagctccaaaaggatggaccctcgcggagctacaccaaaccggcaaaagaaactctctcaaaggccaaatcgttggtctcatccacgcttgccagtacatgaggctccccctcatgctctttaacttaattgtcatcgtcgttaagcttttctccggttaaaaacacactagtttttcttttcttttttgttgacccttgtcagaacaaatgacttttgttgttgaaatttaaaaatcaaaagctcgcatttgtgtaaaac

SEQ ID NO: 347 - DNA, 1165 bp, Brassica napus
gacacatttgcttttaacaaccgcaagaaccaaactgataaataacaaaacctctgggaaaccttttcttggcaaagcttacataatgggaatggtgtttggtaaaatctccgtggagacacccaaatacaccgtggtcaaatcctgcgacggttacgagatccgtgagtatccacccgccgttgcggccgagatcacttacgatccttctgagttcaaagacaacagagacggggggttcacggtcttggccaagtacataggcgtgttcggcaaacctgagaaccagaagcctgagaagatcgccatgacagctccggtgatcaccaaggaaggggagaagatcgccatgacagctccggttgtgaccaaggaagaaggtggggagaagaagacggtgacgatgcagtttctgttgccggaagtgtacaagaaggcggaggacgcgccgcgtccgacggacgagagggtggtgattaaggaggaaggagggaggaagtacggcgtggtcacgttcggtggaaatgcggcggagagtgtggtgggggagaaggtgaagaagctgaggagtgatctcgagagagatgggtttaagatcacaggagattacgtccttgctaggtataatcctccgtggacgttacctcctttcaagaccaacgaagtcatgatccctgttgaatgaagaacactagatccaaagtcttttcagaacaataatgtatacaggttttgaattttaatgaattaacgacaaagtacttgttccgacaagggttaacaaaaaaaaaaaaaagagaagtgtgtttaggttgaattattagaatctaattttattttgttattaaccggagaagagcttaaaaacgatgacgattaagttgaagagcatgagagggagcctcatgtagtggcaggcgtggatgagaccaacgatttggcctttgagggagtttcttttgccggtttggtgaagctccgtgagtgtccatcctctgggagctaagaaacggtcttcgttgaggatagccagtgcgtttgcgaatagcaacaacccttccatcagtgtccagaaccccatgatgtatttctatgtgtgttgaaatccacggcgtcgagaatcgaattgaatggagatttgattccccgcgtactctgcgttgat

SEQ ID NO: 348 - DNA, 467 bp, Brassica napus
gaaattgcagatttgcaggcttcgtcatcttcaacgagatctctccaacacgtcaacctccagtcgattcacctagagacatcatgggattctggacactaatggaagggttgctgctatttgcaaacgcactagctatcctcaacgaagaccgtttcctagctccaaaaggatggacactcgcggagctacaccaaaccggcaaaagaaactctctcaaaggccaaatcgttggtctcatccacgcttgccagtacatgaggctccccctcatgctctttaacttaattgtcatcgtcgttaagcttttctccggttaaacacacacaagtcagaacaagcactttgttgtttatgcctcgataaaaatttaaaatcaaaagtttgcgttgtatacattattgttcttgttatttgttcaactacaaacacaaagtggaacagaacaacatgttcttgagaccata

SEQ ID NO: 349 - DNA, 455 bp, Brassica napus
ttgaacgggtaacamaaccggttcatattagtgatcaactgatcatcttcgtctcttgaacaagctctctctaacccttttaaccccgattcgtttcgattcgactcagctagaaatcatcatggggttctggacactgatggaagggttgctgctattcgcaaacgcacttgctatcctcaacgaagaccgtttcttagctcccaaaggatggacactcgcggagctacaccaaaccggcaaaagaaactccctcaaaggccaaatcgtcggtctcatccacgcctgccagtacatgaggctccccctcatgctcttcaacttaattgtcatcgtctttaaactcttctccggttaaaaaatatcatattcaaatacactagttgatccttgtctgaacaaacactttgttgttgattcatccatgttcgttcaatagaaattttaaaaccaaa

SEQ ID NO: 350 - DNA, 462 bp, Brassica napus
ggaacaagatctctcttaactctttaaccccgattcgattcgactcagctgtaattagttaggccaaaggattctaaccaggcttggagcttaccacaagtcaagtttcctcctttacttgagtaaaatcatcatgggattctggacacttatggaagggttgctgctattcgcaaacgcacttgctatcctcaacgaagaccgtttcttagctcccaaaggatggacactcgcggagctccaccaaaccggcaaaagaaactccctcaaaggccaaatcgtcggtctcatccacgcctgccagtacatgaggctccccctcatgctcttcaacttaattgtcatcgtctttaaactcttctccggttaacaaaaaaaatcatattcaaatacactagttgatcctttgtcttaacaagcactttgttgtttattcatccataaaactagcattgtattggt

SEQ ID NO: 351 - DNA, 486 bp, Brassica napus
gagtgatcaactgatcatcttcgtctcttgaacaagctctctctaacccttttaaccccgattcgtttcgattcgactcagctttaggccaaaggattctaaccaggcttggagctactacaagtcaagtttcctcctttacttgagaaatcatcatggggttctggacactgatggaagggttgctgctattcgcaaacgcacttgctatcctcaacgaagaccgtttcttagctcccaaaggatggacactcgcggagctacaccaaaccggcaaaagaaactccctcaaaggccaaatcgtcggtctcatccacgcctgccagtacatgaggctccccctcatgctcttcaacttaattgtcatcgtctttaaactcttctccggttaaaaaatatcatattcaaatacactagttgatccttgtctgaacaaacactttgttgttgattcatccatgttcgttcaatagaaattttaaaatc

SEQ ID NO: 352 - DNA, 460 bp, Raphanus sativus
ggaaagataattgcaggcttcgtcatcttcaacgaacgagatctgtcctaacacttgagcctcgactcgatttcgattcacccagagagagagagagagaaaccatggggttctggacactgttggaaggactgctgctatttgcaaacgcacttgctatcctcaacgaagaccgttttctagctccaaaaggatggacactcgctgagcttcaccaaaccggcaaaagaaactctctcaaaggccaaatcgttggtctcatccacgcttgccagtacatgaggcttcctctcatgctctttaatttaattgtcatcgtctttaagctcttctccggttaaaaaaaccaagtcagaactagccctttgttgttgatgcatctttaaacaaaaattttaaatcaaaagctcgcattgtattacattattgttcttttactacactgacagagtcgaatgga

SEQ ID NO: 353 - DNA, 471 bp, Raphanus sativus
ggwagtcgrswmaasccggttcatattacaggctaagctyagtgtcagcttcgtctcgtgaacaagatctctctaaacccttcaacctcgattcgattcgattcgattcgattcgactcagctacagaaaccatcatgggattctggacactgatggaaggactgctgctattcgcaaacgcrcttgctatcctcaacgaagaccgtttcttagctcccaaaggatggacactcgcagagctycaccaaaccggcaraagaaactctctcaaaggccaaatcgtcggtctcatccacgcctgccagtacatgaggcttcccctcatgctcttcaacttaattgtcatcgtctttaaactcttctccggttaaasaaaaaaaacacaatttcaaatactttcaatccaaacacttctacaactttattgttgattcatccatgttcattttataatgaatttcaaattaaca

SEQ ID NO: 354 - DNA, 735 bp, Brassica rapa
tctcatcaacatcatccctgtgctcaaaaccagaacaaatcatgcaaaacccccctcccataatctcatctcctaggtttctgcagcctcagacaagatctcttcctcatcatgagcagcatcaacatctgtctaatccttacccaacaacatttgttcaagcagacacttccactttcaaacaagttgttcagatgctaacgggctcctcttccaccgataccaacaccggaaaacaccacgaagctccttctccggtgaacaacaacaaaggaggtttctcaataccacccatcaagaaaaccaacagcttcaagctctacgaaagaagacaaaacaataacaacaacatgtttgctaagaatgacctaatgatcaatactttaaggcttcaaaactctcagaggttgatgttctcaagcggaaacaatgttcatcaaagcccaagattctctccaaggaacagttcatcagagaatgttcttctgtctccaagcatgctagatttcccgaagctagggttaaacagtcccgttactccactgagaagcaacaatgaccccttcaacaagtcatctcctttgtctttaggcagctcatctgaagaagacaaagccatcgctgaaaaaggatactttcttcatccttctccagtttcacctcctagagactctcagccactgcttcttcctcttttccgggtacttctcgaggatccataatctgagagtgtcc

SEQ ID NO: 355 - DNA, 1057 bp, Raphanus sativus
ggacatcaacaacttccagtcgtcttcttattctctttcaatcattccctctttttttttaccctcatacacacacagaagggtatcattaatggaggtctcatcaacgtcatccccgtgttcaaaacctgaacaaatcatgccaaactcccctcccctaatctcatctcctaagtttcagcatcagatgrcaagatctcctcatcatgatcagcatcaacatctctcaaatccttacccaacaacatttgtccaagcagacacttccactttcaaacaagttgttcagatgcttacgggctcctcttccaccgataccaacaccgagaaacaccacgaagctccttctccttctccggtgaacaacagcaaaggaggtttctcaatcccacccatcaagaaaaccaacagcttcaagctctacgaaagaagacaaaacaataataacaacatgtttgctaagaatgatctaatgatcaatactttaaggcttcagaattctcagaggttgatgttctcaagcggaaacaatgttcatcaaagcccaagattctctccgagggataactcatcagagaatrttcttctgtctccaagcatgctagatttcccgaagctagggttaaacagtcccgttacgccactgagaagcaacaatgaccccttcaacaagtcatctcctctgtctttaggcagctcatctgaagaagacaaagccattgccgaaaaaggatactatcttcatccttctccagtttcaactcctagagactttcagccactgcttcttcctctttttccggttacttytccgaggaatctataaatcctgacgagtgttcacattctatatatgatattaagttaaatatattcttggactttgcttttaactataactaagatatataacttcttagtaatggagtractgtaatgtttatgcggtttatatattcaataattcgttgcaatttagctaattggacggtagatatattgcatgaaccatgatactgatttaagacattatttttttaatgaaaagatcgtttac

SEQ ID NO: 356 - DNA, 1782 bp, Arabidopsis thaliana
aagtcgcaacgctccaacgacttcaattcaatttactttcgattttgtcctcttccaaaaacccttccgcttaaaccctaattcacttcgccggccatgtcgacactcgaggatggatttccggcggataagctcttcgctcaaggatactcttacacctacgacgacgtcatctttcttcctcacttcatcgatttctccacagacgctgtttctctatccacgcgccttagccggcgcgtgcctctctccataccttgcgtttcgtctccgatggatactgtttcggaatctcacatggctgctgctatggcttctcttggtgggattggaatcgtccactataactgtggcatcgccgctcaagcatcgattattcgccaagctaagtcgcttaaacatccgattgcttccgacgccggtgtgaagttcccggagtatgagattacttctttagatgcttttggtccttcttccttcgtttttgtcgagcaaacaggaacaatgacgactcctaaattgttaggctatgtaacgaaatcgcagtggaagagaatgaattacgaacaaagggagatgaagatatacgattacatgaagagctgtgatagcagtgactattgtgtaccatgggaaattgattttgaaaagttggagtttgttttagaagataagcaaaagggctttgtggttcttgagagggatggtgagactgtgaacgtggtgacgaaagatgatatacagagggttaaaggatatcccaagtctggaccagggactgtgggcccagacggtgagtggatggttggtgcagcgataggtacgagggagtctgataaggagaggcttgagcatttggttaatgttggggtcaatgctgtagtgttggatagttcgcaagggaactctatttaccagcttgagatgatcaagtatgtgaaaaagacttaccctgaattggatgtgattggtggcaatgttgtgacaatgtaccaggcacagaatttgatccaagcaggagttgatgggttgagagttggtatgggatctggttcgatatgtaccacacaagaggtttgtgcagttggtcgtggacaggctactgctgtgtacaaggtttgttcgatcgctgctcagagcgggattccagttatagcggatggtggtatctcaaattcagggcacattgtaaaggctctcgtccttggagcatcaactgttatgatgggtagctttttagctggaagtactgaggctcccgggggttacgagtatacgaacggtaagaggatcaagaagtaccgtggaatgggatcgctagaagcaatgactaaaggaagtgaccaaagatacttaggagatcaaacaaaactcaagattgctcaaggagtggttggagcagtcgcggataaaggctcagtgttgaagctgataccttacacaatgcacgccgtgaaacaaggtttccaagaccttggtgcttcttccttgcaatctgctcatggtctgttgagatcaaacatccttaggcttgaggctcgaactggtgctgcacaggtcgaaggaggagttcacgggctggtttcttatgaaaagaaatcgttttaagctttggcctaaaattgagtgctaagagtgtttcttatatcatgttccatgttatttttatagatattacttttcaatctagtaactttagtctttttatttattgacatgatttacattgtctcctaaaatcaattttcctctaatattgtcttatatctactaagttactag

SEQ ID NO: 357 - DNA, 1716 bp, Brassica napus
gacaagacacaagtgccaacttcttctgtctcaacttgtcgtcttccttttattcgaatctccccaaaagccctagcttaaatcctaaccacccccgcctctctctcaagatgacgtctttcgaagatgggttcccggcggagaagctcttctctcagggatactcctacacatacgacgacgtcatcttcctccctcactacatcgacttctccaccgacgccgtctctctctccacgcgcctcagccggcgcgtgcccctctccatcccctgcgtctcctctccgatggacaccgtctcggagtctcacatggccgcagcgatggcctccctcggcgggatcgggatcgtccactacaactccgacatcgccgctcaggcgtcggtgatccgacaagccaagtcgctgcgtcatccgatcgcttccgacgccggcgtgaagctcccggagtacgagatcacttcgttggatgcctttggtccttcctccttcgtcttcgtcacgcaatcaggaacaatgacggttccgaagctgttaggctacgtcacgaaagctcagtggaaaaagatgaactacgagcaaagagagatgaagattcacgattacatgaagagctgtgaaggcagcgagtattgtctaccatgggacattgacattgagaagatcgaagctttgttagaagataarcaaaagggctttgtggttctcgaaagggacggtgagactgtgaaygtkgtgacgaragacgayatagagagggtyagagggtatcccaagtcagggccwgggactgtwggtkyagacggggagtggatggttggygcggcgatagggacgagggagtcygataaggagaggctrgagcatttggttaaagctggggctaatgttgtggtgttggatagttctcaagggaactctatttaccagcttgagatgattaagtatgtgaagaagagttatcctgagttggatgtgattggtggtaacgttgtgacgagttaccaggcgcagaacttgattcaagctggtgttgatgggttgagagttggtatggggtctggttckatwtgtaccacacaagaggtttgcgcggttggtcgtggacaggctactgctgtgtacaaggtttgttcactcgctgctcagagtgggattccrgttatagcrgatggtggtatctcaaaytcaggtcacattgtaaaagctctagtactyggagcatcaactgttatgatgggaagcttcttagccggaagcactgaggctcctgggtcttacgagtataagaatggtaagaggatcaagaagtaccgtggaatgggatcgctagaagcaatgacaaaaggaagtgatcagagatacttaggagacaaaacaaatctcaagattgctcaaggagtggttggtgcagtggctgataaaggatcagtgttgaagctgattccttacacaatgcacgcggtgaagcaaggttttcaagaccttggtgcttcttccttgcaatctgctcatgatctgttgagatctaacgtcctcaggctcgagactcgaaccggtgcagcacagatcgaaggtggagttcacggtcttgtttcttatgagaagaaatcattttaagctttgcccaaaaattttgagggatatgttttgagttattcacatactattgctcatgttacatttttcatttttatttattttaacattttta

SEQ ID NO: 358 - DNA, 1760 bp, Brassica napus
cggcacgaggcctcactaaaccctagctttatcctctatctgttcacttctcactctctctctcacgctcggcagctacgccttttactgtagcttcgatggcttcgggattcgaggatggattctcagcggagaagctcttcgcgcagggatactcctacacctacgacgacgtgatattcctccctcactacatcgacttctccacagacgccgtctcgctctccacgcgcctcagcaagcgcgtcccgctctccatcccctgcgtcgcttcgcccatggacaccgtctccgagtcccacatggccgctgctatggccgcgctcggaggtatcggaatcgtccactataactgcgacatcgccactcaggcttccgtcatccgccacgctaaatccctccgtgttccgattgcctccgacgccgttttcaagtgccctgagaatctgattggttcggttgatgacttcggtccttcttccttcgtttttgtctctcagacagggacattgacaccgagtttgttgggttatgtctcaaaatcggagtggtcttgtatgaaagatgaacaaaaggagatgaagatatacgactacatgcgtagctgtgagagcagagactactatgttccgtgggatatcgatctcgacaagatcgatgcggttttggaagataagcagaaagggtttgtggttctggagaaagatggtgagaccgtgaatgtagtgacaaaagacgatgtggagagggttaaagggtaccctaagttagggtcaggaactgtggtctgacaagaagtggatggtgggtgcagccatagggacaagggagtcggataaggagaggttggagcatctggtgaaagctggggctaacgttgtggtgttggatagttcgcaagggaactctatttaccagattgagatgattaaatacgtgaagaatttgtatccggagttggatgtggtcggtgggaatgtggtgactatgtaccaggctgagaacttgatcaaagctggagttgatgggctgagagttggtatggggtctgggtctatatgcactactcaagaggtttgtgctgttggacgcgggcaggctactgctgtgtacaaagtctcgacgctagctgctcagcacggtgtacctgttatagcagatggagggatatcaaactcaggtcacattgtgaaggctctagtccttggagcatcaactgtgatgatgggaagcttcttagctggaagcactgaggctcctggagcttatgaatatcgaaacggtaggagagtgaaaaagtaccgaggcatgggttcattagaagcgatgacaaaaggaagcgaccaaagatacttgggagacacggcgaagctcaagattgcacaaggagtggtgggagcagtggcggataaaggctcggtattgaagttcataccttacacaatgcatgccgtgaagcaaggtttccaagatcttggtgcttcctctttgcaatccgctcacgagctattgagagaaaacgtccttagactagaggctcgtaccggtgcagcacagattgaaggaggagtccacggactggtttcttacgaaaagaaatcattttagctttttctgagtttattttcttatgtaacgctgcaataaagaccttgtctcccttaatctttttatcgtgtttcgttatgatatttatgttcttgttttcagttttgtattaaacacaaaaaatggaaaataataaagctgtttgattgccc

SEQ ID NO: 359 - DNA, 1508 bp, Raphanus sativus
ggatcaaacatcaaatctcatcttcatatctagttcgtcttgatctgctttattcaacctaaataaaagagagagatatgggatcattagtgaaagaaggagcgtcatcttcgttgatgacggagtttttagagaagtgcggcggttatgcggtggtggatggagggtttgcgacagagctagaacgacacggggctgatatcaaggatccactttggagtgccaagtgcctcattacttctcctcacctcgtcacaaaggtgcacttggattacctagagtctggagcaaacatcatcmtcaccgcatcrtaccaggcgacgatccaaggatttgtagctaagggtttatcggtggacgacgcagagagtttgctgcggaggagcgtcgaactctcgtgtgaggcacgtgagattttctacaacagatgcaacaagggctcttgggattttgaccacgtcggaaaagcttcccggcgaccggttcttgtcgcagcttccgttggtagctatggagcttatctcgctgatggctcggaatacagtggagtatatggagaatatgtgagcaaagagacattgaaggacttccatagaagaagagtccaaatcctagcaaaatcgggagccgatctaattgcattcgagaccattccaaataagcttgaagctgaggcttacgtggatcttcttgaagaggaaggcattgacattccagcatggttctcgttcacttccaaggatggagtcactgtgccaagtggagagtctattatagaatgcgcgaaagtggcagattcttgcaagaaagcggtggccataggaatcaattgtacagcaccaagatatattcatgatttgattatctccttgcgccaggtgactcgcaaaccgatcattgtgtacccaaatagtggagaagtctacgacggcctgaacaagaagtggattcaatcagaggaggaagcagaggaggattttgtgtcgtatgtgagtagatggaaagaagaaggggcatctctrtttggagggtgttgtcggactactccaaacactatcagagccattgctaaagtgctctcctgcgagtctccaacaccatcaaaacttaagttctggtagtagacttgtctaagatggagtctgcgcttgtggtgtcaggtaggagtttggaatatacataggcgcaactctaatgatatgtatgatcatatactaatatgttttattctgtgttattagatcatctatatatatccttgtctattttcgcaactaaaagaatggcaactatgttagtagagacagatgtgttggttataaggccggataagataataagagtaatgtcggggtcgggtataaagtgatggttttatgttgatgtatatagaagtgtacttctatctgttttgtaagaaagatgttatggaataaacttctacttgtcttctgtgtgtgagcaatattccattactcgataaatctaaaaagaggcatttagagcca

SEQ ID NO: 360 - DNA, 1505 bp, Brassica oleracea
gatgtggyggcttycyyaaaaccctaatctttgcacttcstctctmtmyccaaaacccttytctctctcttycctcgcgtgtgaaacttaagagaaaaaccatgactaagaagaataacaacaacaacgaggaagaagagttcgtcagcttcggacacaacctgaacacgaagatacgctttgaagatgctgatgaagacgaagttgcagaaggctccggtttggaagccgctcaagacgaatcaatgtgcgaagctggagagagcaccgatgcagctgaagtcactgatgataccaccagcgccgattactacttcgattcctactctcacttcggaattcatgaagagatgttgaaggatgtagtgagaacaaagacttaccagaacgtaatttaccaaaacaagtttctcatcaaggacaaaattgttcttgatgtgggagctgggacaggaatcttgtctctcttctgtgccaaggcwggagcwaaacatgtctacgctgttgaatgytctcaaatggctgacatggcwaaggagattgttaaagccaatggmttttctgatgtwataacggttttgaaagggaagattgaggagatagagcttcctactcctaaagtggatgtgatcatatctgagtggatgggttactttctgttgtttgaaaacatgttggacagtgtcctgtacgctcgcaacaaatggcttgttgatggtgggattgtgctaccagacaaagcctctctctttcttacagccatagaggattcagagtataaagaagacaaaattgaattttggaacagtgtgtatggttttgacatgtcatgcatcaagaaaaaggctatgatggagccgcttgttgacactgtcgaccaaaaacagatcgtcactgatagtagactacttaagacgatggatatctcaaagatgtcttctggtgatgcttccttcacagctcccttcaaacttgttgcacaacgcwatgactacatccacgcactcgtagcctactttgacgtgtcgtttaccatgtgccacaagctcctaggcttctcacaggaccgragtcacgggccacgcactggaaacwaacagtcatgtaccttgaagatgtgttaacaatatgtgagggtgagacaatcactggaagcatgtcggtttcttataacaagaagaatcctagagacattgacattaagctaagctattctttggatggtcagcattccaaggtctcaagaactcaacactacaaaatgcgttgaagttccctcaaaaagaagcatagctttaaactttcagctgaaactgagaagatacagtttctcaaattgtgatattagtttttgtatttttttgtcttcaagttttgcaacattccctttgcttcacagtccacactgctacatttatcttttatgtttctgagtttcagattaattatttccttctaaactaactcttgtacgtgtctatcttgtgtgacatgtttgttgtctt

SEQ ID NO: 361 - DNA, 1411 bp, Brassica rapa
ttccgaaataaaagcatgtggtggctttcataaaaccctaatctttgcacttcgtctctatctccaaaacccttttctttctctcttcctcgcgtgtgaaacttaagagaaaaaccatgactaagaagaataacaacaacaacaacgaggaagaagagttcgtcagcttcggacacaacctgaacacgaagatacgcttcgaagatgctgatgaagacgaagttgcagaaggctccggttttgaagccgctcaagacgaatcaatgtgcgaagctggagagagcaccgatgcagctcaagtcactgatgataccaccagcgccgattactacttcgattcctactctcacttcggaattcatgaagagatgttgaaggatgtagtgagaacaaagacttaccagaatgttatttaccaaaacaagtttctcatcaaggacaagattgttcttgatgtgggagctgggacagggatcttgtctctcttctgtgccaaggctggagctaaacatgtctacgctgttgaatgttctcaaatggctgacatggcaaaggagattgttaaagccaatggattttctgatgtgataacggttttgaaagggaagattgaggagatagagcttcccactcctaaagtggatgtgattatatctgaatggatgggttactttttgttgtttgaaaacatgttggacagtgtcctatacgctcgcaataaatggcttgttgatggtggaattgtgctaccagacaaagcctctctctttcttacagcaattgaggattcagagtacaaagaagacaaaattgaattttggaacagtgtgtatggttttgacatgtcatgcatcaagaaaaaagctatgatggaaccacttgttgacacagtcgaccaaaaccagattgtcaccgatagtaagctacttaagacaatggatatctcaaagatgtcttctggtgatgcttccttcacagctccttttaaacttgttgcgcaacgcaatgactacatccacgcccttgtagcctactttgatgtatcgttcaccatgtgccacaagctgcttggtttctcaacaggaccgagatcccgagctacgcactggaaacaaacagtcatgtaccttgaagatgtgttaacaatatgtgagggtgagacgatcactggaagcatgtctgtttcgtataacaagaagaatcctcgagacgttgacataaagctaagctattctttgaatggccagcactccaaggtctcaaggactcaacactacaaaatgcgctgaagttcaaaacttcaaatttgcaaattgtgattttagtttttgtatttctttttcagtttttcaacattccatttgcttcacactgcaatactttttcagagttgaattcatgattttgctct

SEQ ID NO: 362 - DNA, 1381 bp, Brassica napus
ttctctctctcttccctcggctctaagagaaacgatgacgaagaagaacaacaacaacaacgaggaggaagaagagttcgtcagctttggacacaatctgaacacgaagatacgcttcgaagacgctgatgaagacgaaactgcacaaggctccgctgaagccgccaccgcccaagatgaacccatgtgcgacgccgcagatatcacaaccgacgccgccgatgataccaccagcgccgattactacttcgactcctactctcacttcgggattcatgaagagatgttgaaggatgtagtgagaaccaagacttaccagaacgtgatttaccagaacaagtttctcatcaaggacaaagttgttcttgatgttggtgctgggacagggatcttgtctctcttctgcgccaaggctggagctaaacatgtctacgctgttgaatgttctcaaatggctgacatggctaaggagattgtcaaggccaatggcttttctgatgttataacggtattgaaagggaagattgaggagatagagcttcctactcctaaagtggatgtgattatatctgagtggatgggttactttttgttgtttgaaaacatgttggacagtgtcctttacgctcgcaacaaatggcttgttgatggtgggattgtgttaccagacaaagcctctctctttcttacagccatagaggattcagagtataaagaagacaaaattgaattttggaacagtgtgtatggttttgacatgtcatgcatcaagaaaaaggctatgatggagccgcttgttgacacygtcgaccaaaaacagatcgtcactgatrgtagrctacttaagacgatggatatctcaaagatgtcttctggtgatgcttccttcacagctcccttyaaactwgttgcacaacgyaatgactacatccacgcactcgtagcctactttgacgtgtcgtttaccatgtgccacaagctcctaggcttctcaacaggaccgaagtcacgggccacgcactggaaacaaacagtcatgtaccttgaagatgtgttaacaatatgtgagggtgagacaatcactggaagcatgtcggtttcttataacaagaagaatcctagagacattgacattaagctaagctattctttggatggtcagcattccaaggtctcaagaactcaacactacaaaatgcgttgaagttccctcaaaaagaagcatagctttaaactttcagctgaaactgagaagatacagtttctcaaattgtgatattagtttttgtatttttttgtcttcaagttttgcaacattccctttgcttcacagtmcacactgctacatttatcttttatgtttctgagtttcagattaacc

SEQ ID NO: 363 - DNA, 1474 bp, Brassica napus
  misc_feature (1399)..(1402): n is a, c, g, or t
  misc_feature (1460)..(1460): n is a, c, g, or t
ggcacttcgtctctatatccaaaacccttttctctctctsttcctcgcgtgtgaaacttaagagaaaaaccatgactaagaagaataacaacaacaacaacgaggaagaagagttcgtcagcttcggacacaacctgaacacgaagatacgcttygaagatgctgatgaagacgaagttgcagaaggctccggtttkgaagccgctcaagacgaatcaatgtgcgaagcyggagagagcaccgatgcagctcaagtcactgatgataccaccagcgccgattactacttcgattcctactctcacttcggaattcatgaagagatgttgaaggatgtagtgagaacaaagacttaccagaacgtaatttaccaaaacaagtttctcatcaaggacaagattgttcttgatgtgggagctgggacagggatcttgtctctcttctgtgccaaggctggagcaaaacatgtctacgctgttgaatgttctcaaatggctgacatggcaaaggagattgttaaagccaatggattttctgatgttataacggttttgaaagggaagattgaggagatagagcttcccactcctaaagtggatgtgattatatctgaatggatgggttactttttgttgtttgaaaacatgttggacagtgtcctatacgcgcgcaacaaatggcttgttgatggtggaattgtgctaccagacaaagcctctctctttcttacagcaattgaggattcagagtacaaagaagacaaaattgaattttggaacagtgtgtatggttttgacatgtcatgcatcaagaaaaaagctatgatggaaccgcttgtcgacacagtcgaccaaaaccagattgtcaccgatagtaagctacttaagacaatggatatctcgaagatgtcttctggtgatgcttccttcacagctccctttaaacttgttgcgcaacgcaatgactacatccacgctcttgtagcctactttgatgtatcgtttaccatgtgccacaagctgcttggtttctcaacaggaccgagatcccgagctacgcactggaaacaaacagtcatgtaccttgaagatgtgttaacaatatgtgagggtgagacaattactggaagcatgtctgtttcgtacaacaagaagaatcctagagacgttgacatcaagctaagctattctttgaatggccagcactccaaggtctcaaggactcaacactacaaaatgcgctgaagttcaaaacttcaaatttgcagctgaaactgagaagataacaattctcaaattgtgattttagtttttgtattccttttcagttttgcaacattccatttaccactgcwwcatttgtttaattacatgatttgctctaaaccatccttaagggnnnnttgctgaatatagcatacacaaattctttcccccgcggtcccgtgcgggcgggccgcnggggcggggggggc

SEQ ID NO: 364 - DNA, 1147 bp, Zea mays
ccccccgatccccaaaaaccctttcctctcttccttcttgtgtgagaccgagaaaaaaagatgactaagaacagtaaccacgacgagaatgagttcatcagctttgaaccaaatcagaacacgaagatacgctttgaagatgctgatgaagacgaagttgctgaagggtctggtgttgccggcgaggaaactccccaagatgagtccatgttcgacgccggagagagcgccgacaccgctgaagtaactgatgataccaccagtgccgattactacttcgattcttactctcactttggaatccatgaagagatgttgaaggatgttgtgagaacaaagacttatcagaatgttatttatcagaacaagtttcttatcaaggacaaaattgttcttgatgttggagctggaaccggaattttgtctctgttctgtgccaaggcaggagctgctcatgtctacgctgttgagtgttctcaaatggctgacatggcaaaggagattgttaaagctaatggattttctgatgttattacggtattgaaagggaagattgaggagatagagcttcccactcctaaagtggatgtgattatatcggaatggatgggttactttttgttgtttgaaaatatgttggacagtgtcttgtatgctcgtgataaatggcttgttgaaggtggagttgtgctaccagacaaagcctctctgcatcttacagccatagaggattcagagtacaaagaagacaaaatcgaattttggaacagtgtgtatggttttgacatgtcatgtattaagaaaaaagctatgatggaaccacttgttgacacagtcgaccaaaaccaaatcgtcaccgatagtaggcttctaaagacgatggatatctcaaagatgtcctctggtgatgcttccttcacagctccctttaagcttgttgcacaacgcaatgactacatccacgcccttgtagcctactttgatgtatcgtttaccatgtgccacaagctgctgggcttctcaacaggaccgaaatcccgagctacacactggaaacaaacagttctgtatctagaagatgtgttaaccatatgtgagggtgagacaatcactggaactatgtccgtttctcctaacaagaagaatc

SEQ ID NO: 365 - DNA, 1469 bp, Raphanus sativus
ggaatctttgcagttcgtgtctatctccaaaacccttctctctctttgctccgtttcctctctcttcctctctcttccctcgtgtgtgaaacctaagagaaaaaccatgactaagaataacaaccacaacgaggaagaggagttcatcagcttcggacacaacctgaacacgaagatacgctttgaagatgctgatgaagacgaagtcgcagaaggctctggtctggaagccggccaagatgaatccatgtgcgacgcaggagagagcaacgatgcagctgaagtcactgatgataccaccagcgccgattactacttcgattcctactctcacttcggaattcatgaagagatgttgaaggatgtagtgagaacaaagacttatcagaatgtaatttaccaaaacaagtttctcatcaaggacaaaattgttcttgatgttggagctgggacaggratcttgtctctcttctgtgccaaggctggagctaaacatgtctatgctgttgagtgttctcaaatggctgacatggcaaaggagattgttaaagccaatggcttttctgatgtgataacggttttgaaagggaagattgaggagatagagcttcccactcctaaagtggatgtgattatatctgaatggatgggctactttttgttgtttgaaaacatgttggacagtgtcctctacgctcgtaataaatggcttgttgatggcgggattgtgctgccagacaaagcctctctgtttcttacagcaattgaggattcagagtataaagaagacaaaattgaattttggaacagtgtgtatggttttgacatgtcatgcatcaagaaaaaagctatgatggaaccacttgttgacacagtcgaccaaaaccagattgtsaccgatagtaagctacttaagacaatggatatctcgaagatgtcttctggtgatgcttccttcacagctccctttaaacttgttgcacaacgcaatgactacatccacgcccttgtagcctactttgatgtatcattcaccatgtgccacaagctccttggtttctcaacaggaccgagatcccgggctacgcactggaaacaaacagtcatgtaccttgaagatgtgttaacaatatgtgagggtgagacgatcactggaagcatgtctgtttcgtataacaagaagaatcctagagacgttgacataaagctaagctattctttgaatggccagcactccaaggtctcaaggacccaacactacaaaatgcgttgaagttctctcttgaaggagcaaaactttaaatttgcakctgaaactgagaagatgccattctcaaattgtgatgtgatattagtttttgtatttttttccttttccagttttgcaacattgcctttgcttcacactgcmacactttttttccgagttgaatttatgattttgctataagctatttcttgtgttaaga

SEQ ID NO: 366 - DNA, 1440 bp, Thellungiella halophila
ggtctctattccgcaaaaacccttctcctctctttgctccgtttttgctttctcttcccttccctcttgtgtaacaacgatgactaagaagagtaaccacaacgaggaagagttcatgagctttggacagaatcagaacacgaagattcggtttgcagatgctgatgaagacgaagttgcagaagggtctggtgttgccggcgaggaagccgcccaagatgaatccatgtgcgacgccggagagagcgccggagtcaatgatgataccaccagcgccgattactacttcgattcatactcccactttggaattcatgaagaaatgttgaaggatgtagtgagaacaaagacttatcagaatgtaatctaccaaaacaagtttcttatcaaggacaaaattgttcttgatgttggagctgggacaggaatcttgtctctgttctgtgccaaggcaggagcagctcatgtatacgcttgaatgttctcaaatggctgacatggcaaaggagattgttaaagcgaatggattttctgatgtcataacggttttgaaagggaagattgaggagatagagcttcctactcctaaagtggatgtgattatatctgaatggatgggttactttttgttgtttgaaaatatgttggacagtgtcttatacgctcgtgataaatggcttgttgatggtggaattgtgctacctgacaaagcctctctgtttcttacagccatagaggattcagagtataaagaagacaaaatagaattttggaacagtgtgtatggttttgacatgtcatgcatcaagaaaaaagctatgatggaaccacttgttgacacagtcgaccaaaaccaaattgtcaccgacagtaggctactcaagacaatggatatctcaaaaatgtcttccggtgatgcttccttcacagctccctttaaacttgttgcacaacgcaatgactacatccacgctcttgtagcctactttgatgtatcgtttaccatgtgccacaagctgctgggtttctcaacaggaccgagatcccgggctacacactggaaacaaacagtcatgtacctagaagatgtgttaaccatatgtgagggtgagacaatcactggaagcatgtccgtttcgtataacaagaagaatcctcgtgacgttgacataaaactaagctattctttagatggccaacattccaagatctcaaaaactcaacactacaaaatgcgctgagcttctctcaaaagaagcagaacttcaagtttacagctgaaactgagacgcatttctcaaatttgtgattttaatttttgtattttttttccagttttgcaacattccctttgcttcactacgcaacatttgtttttttctgagttaaatttatgatttttcactaaaccatcacattgtatgttatttcttctgttac

SEQ ID NO: 367 - DNA, 1688 bp, Arabidopsis thaliana
atggagtagttcaagcagattttgcaccacatcatcctctgttacaacccctgaagatccttgaggaagaagaagtcaaatatggaaggtcaaaccctaattttcacattccttttcatatctctttctctcacgtttatcatcggaagaatcaagcgaagacctaaccttcctccgagtccgtcgtgggcgttaccggtgatcggtcacctccgccttctcaagccgccactccaccgagtttttctatccgtctctgagtccctaggcgatgctccgataatctccctccgtctcggcaaccgactcgttttcgttgtctcttcacactcactcgccgaggaatgcttcacaaagaacgacgtcgtactcgcgaaccgcttcaactcccttgcttcaaaacacatctcatatggctgcacaacggttgttacagcttcgtacggcgaccattggagaaatctccgccgtattggcgctgttgagatattctcggctcaccgtctcaatagcttttcatctatccgccgagacgagatccaccggcttatagcttgtctctcacggaactcttcactcgaatttacaaaggttgagatgaaatcaatgttttctaacttaacattcaacaacattataagaatgttggctggaaaatgttactacggagatggtgcagaggatgacccggaggctaaacgcgtgcgggagcttatagcagagggaatgggttgttttggtgctggaaacactgctgattatttaccgatcctgacttggatcacaggttccgagaaacggataaagaagatcgctagtaggcttgatgagttcttgcagggattggtcgatgaaagacgagaagggaaggagaaaaggcagaacacaatggttgatcacttgctttgtctgcaagaaacccaacccgagtactacacggacaacattatcaaaggaatcatgctctctcttatactagcggggactgatacatccgcagtaacattggaatggacattgtcagctttgttgaaccatccacagatactaagcaaggcgagagatgaaatcgataataaggttggcctcaacaggcttgtagaggaatcagacctctcacatcttccttatcttcaaaacattgtgtccgagtcgttgcgcttataccctgcgagtcccttgttggttcctcacgtagcatcagaagactgtaaagtagggggttaccatatgccacgtggaacgatgctattgactaatgcatgggcaatacatagggatcctaagatatgggatgatccaacgagcttcaaaccagagaggttcgagaaagaaggggaggctcagaagctattggggtttgggctaggaagaagggcgtgtcctgggtccggtctggctcaacggctagcgagcttgactatcgggtctttgattcaatgttttgagtgggagaggataggagaagaagaggtggatatgactgaaggtggaggaggagtcataatgcccaaagctataccgttggtagccatgtgcaaagcacgccccgttgttggtaagatcctcaacgagtccgcttgagcttagacttttgtactaaatgctaatttgtgttttttgagtaacggttacttttgtactacttttgttattatgtaaaaagaggaaataatttcgaggtgata

SEQ ID NO: 368 - DNA, 4057 bp, Arabidopsis thaliana
aaacttggtcttatgtcttctttcatttaatgtatatctctctcatcttcttcctctctaaccactttcctcccttaatttctatccctatatttattttcctttcattttcctctccaactaattacacacacttgaagctgaaaaaaatgcagccgtccggtgatccggcgccggaaaaggagaaagagatgacgcagccaaaagtgtcactgcttaagctcttctccttcgcagatttctatgattgtgttctaatgactcttggatccgtaggagcgtgcattcatggcgcctcggttccaatctttttcatcttctttggcaaactcatcaatattatcggtcttgcttatcttttcccaaaacaagcctctcacagagtcgccaagtactcgttggattttgtatacttgagtgtggctatactattttcatcatggttagaggttgcatgttggatgcatacgggagagaggcaagcggcgaagatgaggagagcttatctcaggtcaatgttaagccaagacataagcttattcgacaccgaagcttctacaggagaagtcatctccgccatcacctccgacatcctcgtcgtccaagatgctctctccgagaaggtagggaatttcttgcactacataagccggttcatagccggttttgcaattggattcactagtgtatggcaaataagtcttgtcactctatccatagtccccttaatcgctctagctggcggcatctatgcgttcgtcgccatcggacttattgctcgtgtccggaaatcatacatcaaggctggtgagattgcagaagaggtgatcgggaatgtgaggaccgtacaagcattcaccggtgaagaaagggcggtgagattataccgagaagcgctggagaatacgtataagtacgggagaaaagctggtttaaccaaaggattaggtcttggatcgatgcactgtgtcttgtttctatcttgggccttgctcgtatggttcacaagtgttgtggtccacaaggatatcgccgatggtggcaaatcattcactaccatgctcaacgttgtcatcgccggcctgtctcttggacaagcggcgcccgatatttctgcgtttgtacgggcaaaagccgctgcttatccaattttcaagatgattgaacggaacacggtgacaaaaacaagcgcaaaatctggccgtaaactagggaaagtagacgggcacattcaattcaaagacgcgactttcagttacccatctcgccctgatgtggtgatcttcgacaggttaaacctagctatccctgccgggaaaattgtggcacttgttggaggaagcggatcagggaagagcacggtcatatctttgatagagcggttctacgagcctatttctggagcagtgttgctagacgggaacaatatcagtgagctggatattaagtggttaagaggacagattggtttggttaaccaagaaccagctctgtttgcaacaacgattcgtgagaacattctgtatggcaaagacgacgcaactgctgaggagatcacccgtgccgcaaagctctcggaagccatttctttcatcaacaacctccctgaaggatttgagactcaggttggcgagagagggattcaactatctggcggacagaaacaaaggattgctatatcaagagcaattgtgaagaatccatcgatactcttactcgacgaagcaacaagtgctttagacgcagagtcggagaagagcgtgcaagaagcgctggatcgagtgatggttgggagaacaacggtggtggtggctcacagactctcaacggtaagaaatgctgacatcatagcagttgtacacgaaggtaaaatagttgagtttggaaaccacgagaatctcatatctaatcccgacggagcctactcttctcttcttcgtctccaagagactgcctcattgcagcgtaacccttccttgaatcgcacgctaagcagaccacatagtataaaatactcgcgggaactatcaagaacaagatccagcttctgttcagagagggaatcggtaactcgaccggatggggctgatccatccaaaaaagtgaaagtaacggtgggacgtctttactctatgatccgtccggactggatgtatggcgtgtgtggcacgatatgtgcctttatcgctggatctcaaatgccccttttcgcgcttggcgtctcgcaagccttagtttcctattacagtggttgggatgagactcaaaaagagatcaagaagatcgctatcctcttctgctgcgcgtccgttatcactctaattgtctacaccattgagcatatctgctttggcactatgggcgagcgtctcactctccgtgtccgcgaaaatatgttcagagcaatcttgaagaatgaaatcgggtggtttgatgaggtggacaacacaagctcaatgttggcatcgcggcttgagagcgatgcaactttgcttaaaaccatagtggtcgataggtcaacgattctactgcagaacttaggtctagttgtgacctcttttatcatagcatttatactcaactggcgtctcactcttgtcgtcttggccacatacccattggttataagcggacatatcagcgagaaacttttcatgcaaggatatggaggagacttgaacaaagcatacttaaaggccaacatgttggccggtgagtctgttagcaacatccgcacggtcgctgccttctgtgctgaggaaaagattctagaactttattcaagagagcttttagaaccttccaaaagttctttcaggcgtggacaaattgcaggacttttctacggtgtctctcagttcttcattttctcttcctatggcctcgccctctggtacggatcaactttgatggacaaaggattagcgggcttcaaatcagtgatgaaaacattcatggttttgattgtgacggcgttagcgatgggtgagacattggctctagctccggatctgctgaaaggaaaccagatggttgcgtccgtgtttgagatcttggaccggaaaactcagatcgttggagaaaccagcgaggagctgaacaatgtggaaggcacgattgagctcaaaggcgtccactttagctacccttcgagaccagatgttgtaattttccgggactttgatctgatagttcgtgccggaaagagcatggcgctcgttggacagagtggatctgggaaaagttctgttatttcactcattctccggttctatgacccgactgctggaaaagtcatgatagagggaaaagacatcaagaaactagatttgaaagcattgaggaaacacattggtcttgttcaacaagaaccagcacttttcgccacaacaatctacgagaacattttgtatggaaacgaaggagcatctcaatctgaagtcgtcgaatcagctatgctcgcaaatgctcacagcttcattacctctctcccagaaggttactctaccaaagtcggtgaacgtggagttcaaatgtcaggcgggcagagacagaggatcgctatcgctagagccattctcaagaatccagcaattctattacttgacgaagccacaagcgctttggacgttgaatctgagcgtgtggtacaacaagcattggatcggttaatggctaaccggacgactgtggtagttgctcacaggctatcgacgatcaagaacgctgacacgataagtgtattacacggaggtaagatcgtagagcaaggcagccaccgtaagctcgttctaaacaagagtggtccatattttaaacttatcagtcttcagcagcagcaacaaccttaaattaagtactatactttatttattgaaaaactctttttatttttatttttgtggaaaatattgatcatatactcatttgatgtgattatcttaatcttcttgatttaccgttggtaaaaaaaaagttacgaaatccaaaataggaaaatgttctgaaacgttggctatgtattttcacccaaatttggatttagttatttttgagc

SEQ ID NO: 369 - DNA, 3857 bp, Populus trichocarpa
atgagttcacttgcaggcaacattgaagacactgatgatgtggaaaagaagaaggaagagaaaaagaagcaacgcaaagttccattctggaaactatttgcttttgctgatttctacgactatgtgttaatggggttgggatctcttggtgcttgtgttcatggagcttcagtccctgtcttcttcattttctttggaaagttgataaatatcattggattggcttatctctttcccaaagaagcttctcatagagtaggcaagtactcgttggattttgtatatctcagtgtggttatattattcgcatcgtggatagaggtggcatgttggatgcatactggagaaagacaggcagcgaagatgagaatggcctatctaaaatcaatgttaagtcaagatataagtttattcgatactgaagcatcaaccggagaggtcatagctgccattacaagtgatataattgtcgtgcaagatgctatttctgaaaaggttgggaacttcatgcactatataagccgatttctcggtggatttataatcgggtttgttaggatatggcaaatcagtctggtgacgctgtctatagtccctttaattgcacttgctggtggcatctatgcttatataacaatcggccttattgctaaagttcgtaaatcttatgtcaaagcaagccaagtcgctgaggaggtaattggaaatgttagaacagtacaagcatttacaggggaagagaaagcagtgaggtcatatatagaagctctcaggaaaacgtacaagtatgggaggaaagcaggcctggccaagggtcttggattaggaaccttgcattgtgtccttttcctatcatgggctttgcttgtatggtacactagcatagttgtccacaagaatattgctaatggtggcgaatctttcaccactatgctcaatgttgttatttctggcctgtcactgggaatggctgcaccagatatttcatcatttctccacgccacagcagcagcctaccctattttcgagatgatagagaagaacacgatgagcaaaatcagctcagaatctggtcggaaggtagatagagttgatggccacattgaattcaaagatgtgtgttttcggtacccttctcgtcctgatgtaacaatcttcgataaattctgcttagatatcccttctgggaagattgtagcccttgtcggaggaagtgggtctggaaagagcacggtaatatctttgatcgaaagattctatgatcctttgtttggaaagatactgttagatgggaatgatattcgggaccttgacctcaagtggcttaggcagcaaattgggctagttaatcaggagcctgctctttttgcaacaagcatcagagagaacattctctatgggaaagatgatgccacccttgaggaaattacacgtgctgctaaactttcaggagccatgtcttttatcaataacctcccagataaatttgaaacacaggttggggaaagaggaattcaattatcaggcgggcaaaagcaaaggattgcattatcacgtgctatcgtgaaaaatccatccattcttttgctagatgaagctacaagtgcactggatgctgaatctgagaaaagcgtgcaagaggctattgatcgtgccattgttggacgaaccactgtagttgtggctcatcggctttctacaatcaggaatgcagatgtcattgctgtggttcaggaagggaagatagtagaaatcgggagccatgaggagctcatttcaaaccctcaaagtacctatgcttccctcgtccatctccaggaggcagcttccttgcagcgtcatccctcacatggtcctaccttaggacgaccactcagcatgaagtattctcgagaattatcccacacaagatcaagctttggaacaagttttcattctgacaaggattcagttagccgggttggtggtgatgctttggagtccacgaggacaaagaatgtttcactgaaaagattgtattcaatggtcggccctgattggatttatggtgtacttggaaccatgggtgcatttattgccggatccgcaatgccactttttgctcttggagtctctcaagctcttgtagcctactacatggactgggacacaactcgccatgaagtcaagaagattgcaatcctgttttgttgtggtgcagcaattagtgttattgtctatgccattgaacatctctcttttggaatcatgggagagcgactcactcttcgtgtcagagaaatgatgttctctgccattttgaagaacgagattggatggtttgatgatttgaacaatacaagttccatgctcacatcacgtctagagagcgatgcaactttgttacgaactatagttgttgatcgctcaaccattctcttgcaaaatgttggtttggttgtcacctcatttatcatcgcctttacattgaactggaggatcacacttgttgtcatagccacatatccgctgatcattagtggtcacataagcgagaaactctttatgaagggctatggtggcaacttgagtaaagcatatctaaaggctaacatgctagctggcgaggctgtgagtaacatccgcactgttgctgcattctgtgctgaagaaaagatacttgacctttatgcccgtgagcttgtcgaaccttccaagaactcattcactcgtggtcagatcgccggcatattctatggcatatgccagttcttcattttctcatcttatgggcttgctttatggtatggttctgttctgatggagaaggagcttgctggttttaaatctatcatgaagtcatttatggttttgattgtaactgcattagccatgggtgaaactctagcattggcgccagatcttctgaaagggaaccatatggcagcatctgtctttgagatactggatcgcaagacacaggtaatgggggatgtaggagaagagttgaaaaatgtggagggtacaatagagttaagaggtgtccaatttagctatccttcaagacctgatgcattgattttcaaagactttgatctaagagtgcgttcaggcaagagtatggctttagtgggacaaagtggttccggtaaaagctctgtcctttctctgatacttcgtttctacgatccaacagcaggaaaagtgatgattgatggcatagatatcaaggaactcaaggtgaaatctcttcgaaagcacataggcctagtccaacaagagccagctctctttgccacatcaatctatgaaaacattttatatggaaaagaaggagcctccgaagcagaagttattgaagcggctaagcttgctaatgctcacagtttcattagctctcttcctgagggttactcaaccaaagttggtgaacgaggggtgcaattatcaggtggccaaaagcaaagagtggccattgcccgagccgtcctaaaaaatccagaaatcttgctacttgatgaagccactagtgctctagatgtggagtccgagcgtattgtgcagcaagctctggacagattgatgaggaaccgaacaacagtggtagtggcacataggttatcgactataaagaatgcggatcaaatatcaattatacaagaaggaaaaataatagagcaagggactcattctagtcttgttgaaaacaaagacggagcatatttcaagctggttcgtcttcagcaacaaggaggagttgaacagaatcattaacaattgacaacaagaacacggatcactacgaccatctctacaggagctttcttctctgctaaatgatgtgcggtctttctttttctccttccgggccaatcagg

SEQ ID NO: 370 - DNA, 3959 bp, Glycine max
ggtaccctctccggtgactcggccgtggatgatgctaagagcaacaaaaaggaacacaaagtttctctgctgaaactcttctcttttgctgacttctatgactatgttttaatgggtgttgggtctgttggggcaattgtacatggtgcttctgttcccgttttctttatcttctttggaaagttgatcaatgtcataggcttggcctatcttttccccaaggaagcctctcacaaagttgccaagtactcgttggattttgtgtatctaagtatagcaatattgttttcatcttggacagaggtggcttgttggatgcatactggggaacgtcaagctgcaaagatgagaatggcttatttgaaatcaatgttgaatcaagatattagtctatttgataccgaggcttcaacaggagaggttatttcttccattactagtgacattatcattgttcaagatgcactatccgagaaggtggggaacttcatgcactacataagccgatttgtagcgggctttgttattgggtttgttagagtgtggcagatcagtttagtgacactttcaattgtacccttgattgctcttgctggaggtctttatgcatacgtcacaattgggctcattgcaaaagttcgaaaagcctacgtgagggctggtgaaatcgctgaagaggtgattggcaatgttagaacggttcaagcatttgcgggagaagaaagggcagtaagatcatataaagctgcactcatgaaaacttatgtaaacggtagaaaagcaggtttggcaaagggcctgggcttgggctcaatgcactgtgtcctttttctatcatggtctttgcttgtttggttcactagcattgttgttcacaagaatattgccaatggaggcgagtctttcactaccatgctcaacgttgtgatcgctggcctgtcactggggcaggcagcaccagatatatctgcattcattcgagcaaaggcagcagcttatccaatttttgagatgatagagagggacacagtgagcaaaagtagctcaaaaaccggtcgcaagttaggcaaattggagggtcatatccagttcaagaacatctgtttcagttacccgtctcgtccagatgtagcaatattcaacaacctgtgtcttgacattccttcagggaaaattgtagcccttgtgggaggaagtggttctggaaagagcactgtcatatcattgattgagcgcttttatgaaccactttctggtcagatactattagacaggaatgatatcagggaacttgatctcaaatggcttaggcagcaaattgggctggttaatcaagaacctgcgctttttgctacaagcatcaaggagaacatactttatggaaaagatgatgccactcttgaagaactaaaacgtgctgtgaagctttcagatgctcagtctttcatcaacaatcttcctgatagactagaaactcaggttggtgagagaggtatacaactttcaggagggcagaagcaaaggattgcaatatctcgtgcaatcgtgaagaatccatcaatccttttgttggacgaagcgactagtgctctggatgctgagtctgagaagagtgtgcaggaggctcttgatcgtgtgatggttgggagaacaactgttgtagtggcacacagactctctaccattaggaatgcagatatgattgctgttgtgcagggagggaagattgtggaaactggtaaccatgaagagctcatggccaacccaactagtgtttatgcatctcttgttcaactccaggaggctgcttctctacatcgcctcccatcaattggtcctagcatgggacgccaaccaagcataacctactcaagagaattatcccgtacaacaacaagccttggtggtagttttcgatcagataaagaatctattggccgggtttgtgctgaagaaacagaaaatgcaggcaagaaaaggcatgtttcagcagcaaggctgtactctatggttggtcctgactggttttatggggttgctgggaccttatgtgcatttattgctggagcacagatgccactttttgcacttggaatttctcacgcacttgtatcatactatatggactgggagacaacatgtcacgaagttaaaaaaattgcattcctcttctgtggagcagcagttataactgtcactgtccatgccattgaacatctttcttttggaatcatgggagagcgactaacccttcgtgtgagagaaatgatgttttctgctatcttgaagaatgaaattggctggtttgacgatacaaacaacacaagttccatgctttcatcgcagttagagactgatgcaacattattacgaactatagttgttgatcgttcaacaattctgttacagaatattggtttggttgttgcttcatttattgttgccttcatcttgaactggagaataacactggttgtcatagccacatatcctttgatcattagtggtcatatcagtgagaaactttttatgaaaggctatggtggcaacttgagcaaagcatatctaaaagccaacatgctggctggggaggctgtgagcaatatacgcactgttgccgcattttgttctgaagaaaaggtccttgacctttatgctaatgagctcgttgatccctccaaacgctcacttcaacgaggccaaattgctggcatattctatggcatttcccagttctttattttctcatcttatggccttgccttgtggtatggatctgttttaatggaaaaggagcttgctagctttaaatcaattatgaaggcattttttgttttgatagtaacagcactggccatgggggagacattggccctggccccagaccttttgaaagggaatcaaatggttgcatcagtttttgaagtgatggatagaaagtcaggaatatcatgtgaggttggagaagagttgaagacagtggatggaacaatcgagctcaaaagaatcaatttcagctacccttcaaggccagatgtaattattttcaaggatttcaatctaagagttcctgcaggcaagagtgttgccttagtggggcaaagtggttctggtaaaagctcggtgatctcccttatactcagattttatgatccaacatccggaagggtgttaattgatggaaaagacatcacgagacttaatctgaaatctcttaggagacacattggtcttgtacaacaagaaccagctctttttgcaacatcaatttatgaaaacatactttatggaaaagaaggtgcctctgattcagaagtgattgaagcagctaagcttgccaatgctcataacttcatcagtggtcttcctgagggttactccaccaaagtaggtgaaagaggagtgcaactatctggtggccaaagacaaagggtagccattgcaagagcagttctaaagaaccctgaaatcttgcttctggatgaagccactagtgcacttgatgttgagtcagagcgtattgtgcaacaagcattggacagattaatgcagaacagaactacagttatggtggcacataggctatccactataagaaatgcagaccaaatctcagttttgcaagatggaaagataattgaccaagggactcattcaagtcttatagagaataaaaatggagcatactataaattagtcaaccttcaacaacagcagcatcaattatagtatattggaagaacataacaaacgaacatggattttttatactgattttgtatttttttagtttttccccccacgtttatagagaatgatgtgggttgggaagctgatgtcggatccgaataatttcatactatatatatatatatatatatatatatgtttgtaagtgctataaaaaaagtaaaatggcttcatgtatctagttcatgatcctcatttattaagcatca

SEQ ID NO: 371 - DNA, 3964 bp, Glycine max
ggtaccctctccggtgactcggccatggatgatgctaagagcaacaaaaaggaacataaagtttctctgctgaaactcttctcttttgctgacttctatgactatgtcttaatgggtgttggttctgttggggcaattgtacatggtgcttctgttcccgttttctttatcttctttggaaagttgattaatgtcataggcttggcctatcttttccccaaggaagcctctcacaaagttgccaagtactcgttggattttgtgtatctaagtatagcaatattgttttcatcatggacagaggtggcttgttggatgcatactggggaacgtcaagctgcaaagatgagaatggcttatttgaaatcaatgttgaatcaagatatcagcttatttgatactgaggcttcaacaggagaggtcatttctgccattactagtgacattatcattgttcaagatgcactatccgagaaggtggggaacttcatgcactacataagccgatttgtagcgggctttgttattgggtttgttcgagtgtggcagatcagtctagtgacactttcaattgtaccgttgattgcccttgctggaggtctttatgcatacgtcacaattggccttattgcaaaagttcgaaaagcctacgtgagggctggtgaaatcgctgaagaggtgattggcaatgttagaacggttcaagcatttgcgggagaagaaagggcagtaagatcatataaagctgcactcatgaaaacttacgtaaacggtagaaaagctggtttggcaaagggcctgggcttgggctccatgcactgtgtcctttttctatcgtggtctttgcttgtttggttcactagcattgttgttcacaagaatattgccaatggaggcgagtctttcacaaccatgctcaatgttgtcattgctggcctgtcactggggcaagcagcaccagatatctctgcattcatccgagcaaaggcagcagcttatccaatttttgagatgatagagagggagacagtgagcaaaagtagctcaaaaaccggtcgcaagttaggcaaattggagggtcacatccagtttaagaatgtctgtttcagttacccatctcgtccagatgtagcaatattcaacaacctgtgtcttgacattccttcagggaaaattatagcccttgtgggaggaagtggttctggaaagagcactgtcatatcgttgatcgaacgcttttatgaaccaatttctggtcagatactactagacaggaatgatatcagggaacttgatctcaaatggcttaggcagcaaattgggctggttaatcaagaacctgccctttttgctacaagcatcaaggagaatatactttatggaaaagatgatgccactcttgaagaactaaaacgtgctgtaaagctttcagatgctcagcctttcattaacaatcttcctgatagattagaaactcaggttggtgagagagggatacaactctcaggagggcaaaagcaaaggattgcaatatctcgtgcaatcgtgaagaatccatcaatccttttgttggacgaagcgacgagtgcactggatgctgagtctgagaagagtgtacaagaggctcttgatcgtgtcatggttgggagaacaaccgttgtagtggcacacagactctctaccattaggaatgcagatatgattgctgttgtgcagggagggaagattgtggaaactggtaaccatgaagagctcatggccaacccaactagtgtttatgcatctcttgttcaactccaggaggctgcttctctgcatcgcctcccatcaattggtcctagcatgggatgccaaccaagcataacctactccagagaattatcccgtacaacaacaagccttggtggaagttttcgatcagataaagaatctattggccgggtttgtgctgaagaaacagaaaatgcaggcaagaaaaggcatgtttcagcagcaaggctgtactctatggttggtcctgactggttttatggagttgctgggaccttatgtgcatttattgctggagcacagatgccactttttgcacttggaatttctcacgcacttgtatcatactatatggactgggagacaacatgtcacgaagttaaaaaaattgcattcctcttctgtggagcagcagttattactgtcactgtccatgccattgaacatctttcttttggaatcatgggagagcgacttacccttcgtgtgagagaaatgatgttttctgctatcttgaagaatgaaattggctggtttgatgatacaaacaacacaagttctatgctttcatcgcaattggagactgatgcaacattattacgaactatagttgttgatcgttcaacaattctgttacagaatattggtttggttattgcttcatttattattgccttcatcttgaactggagaataacacttgttgtaattgccacatatcctttggtcattagtggtcatatcagtgagaaactttttatgaaaggctatggtggaaacttgagcaaagcatatctaaaagctaacatgctggctggggaggctgtgagcaatatacgcactgttgccgcattttgttccgaagaaaaggtccttgacctttatgccaatgagcttgttgatccctccaaacgttcacttcaacgaggccaaattgctggcatattctatggcatttcccagttctttattttctcatcttatggccttgccttgtggtatggatctgttttgatggaaaaggagcttgctagctttaaatcaattatgaaggcattttttgttttgatagtaacagcactggccatgggggagacattggccctggcccctgaccttttgaaagggaatcaaatggttgcatcagtttttgaagtgatggatagaaagtcaggaatatcatgtgatgttggagaagagttgaagacagtggacggaacaattgagcttaaaagaatcaatttcagctacccttcaaggccagatgtaattattttcaaggatttcaatctaagagttcctgcaggaaagagtgttgccttagtggggcaaagtggttctggtaaaagctcagtgatctccctcatactcagattttatgatccaacatccggaagggtgttaattgatggaaaagacatcacaagacttaatctgaaatctcttaggagacacattggtcttgtgcagcaagaaccagctctttttgcaacatcaatttatgaaaatatactttatggcaaggaaggtgcgtctgattcagaagtgattgaagcagctaagcttgccaatgctcataacttcatcagcggtcttcctgagggttactccactaaagtaggtgaaagaggagtgcaactatctggtggccaaagacaaagggtagccattgcaagagctgttctaaagaaccctgaaatcttgctacttgatgaagccactagtgcacttgatgtcgagtcagagcgtattgtgcagcaagcattggacagattaatgcagaacagaacaacaattatggtggcacataggctatccactataagaaatgcagaccaaatctcagttttgcaagatggaaagataattgatcaagggactcattcaagtcttatagagaataaaaatggagcatactataaattagtcaaccttcaacaacagcatcaattatagcaaaatggaagaacataacaaatgaacatggattttttatactgtgatttttcatttttttagtttttttcccccacgtttatagagaatgatgtgggttgggaagcttatgtcggatcggaataatttcatatactatatatatgtttgtaagtgctattaaaaagtaaaatggcttcatgtatttagtccttgaccctcagttattaagcatcacctctggttattacagctctta

SEQ ID NO: 372 - DNA, 505 bp, Brassica oleracea
aaatcattcttgatccaacaaagaaaacattttcaaacacacatacaattcttgcctatagatcaaagttgttacattaacagttgaagatgagccagtacaacaaccaatctgcaggagctaattctccaccaccgatgtcaaccggtcccgcaccgccgccgccgatgggttacccgacgaacgacccgagtcatggttcggcggctcctgttaaagtggagaccagttctaagggtgacggattctttaaaggatgtcttgcggccatgtgctgctgttgtgccctggacatctgcttctaaggagatacaataacattggaatggttttatctacgaagagttgtgtgaatgtcatgtgaattattattctctctagccttattgtaaaaagaaacattctgttattgttttattggatttcctgtaagacttgtgtttttccattcgaacatattatgtctttactctatatgaatttatggtacttttagttcatttct

SEQ ID NO: 373 - DNA, 509 bp, Brassica rapa
aaacattcttgatccatacaaagagaacatctttacacacacgtaaaattcttgccttagatcaaagtcgttacactaatcgttgaagatgagccagtacaacaaccaatctgcaggagctaattctccaccaccgatgtcaaccggtccagcaccgccgccgccgatgggttacccgacgaacgacccgagtcatggttcggcggctcctgttaaagtggagaccaattctaagggtgacggattctttaaaggatgtcttgcggccatgtgttgctgttgtgccctggacatctgcttctaaggagatatataccataacactgggatggtttaaatttatttacgacgagttgtgtgaatgtcatgtgaattattctctgtagccttattgtaaaacgaaatattctgttattgttttattgatttcctgtaagacttgtgttttttcattcgaacatattatgtctttactctttttgaatttatggtacttttagttcattttc

SEQ ID NO: 374 - DNA, 533 bp, Brassica rapa
gatattcaaagatcaaaaacattcttgatccatacaaagaaaacatcttcacacacacataaagctcttgccttagatcaaatacgttacaactaatcgttcaaagatgagccagtacaatcacaaccaatcttcaggagttaaccctccaccacctatgtcaaccggtccatcgccaccaccaccgattggttacccgacggtcgaccctagtcatggttcggcagctcctgttaaagtcgagaccagttctaagggtgacggattctttaaaggctgtcttgcggccatgtgttgctgttgcgccctggacatctgcttctaaggagattagcgatattataacattggagtggttttatttacgacgagttgtgtgaatgtgatgtgaattgttctctctcgcctattgtttttgtaaaaaataaatattctattattggctattaatttcttgttagagatgggttttgtattcgaacatattgttaaaatttctcttgtctttataaaatttatggtacttttatttt

SEQ ID NO: 375 - DNA, 675 bp, Brassica napus
gggtgacattaatgttctatgctccacgcggttttcaaaaaccgacatttttccttgctttctctctctatatatctacatacacacgcatttgtaaagatattcaaagatcaaaatcattcttgatccaacaaagaaaacatcttcaaacacacatacaattcttgcctatagatcaaagttgttacattaacagttgaagatgagccagtacaacaaccaatctgcaggagctaattctccaccaccgatgtcaaccggtcccgcaccgccgccgccgatgggttacccgacgaacgacccgagtcatggttcggcggctcctgttaaagtggagaccagttctaagggtgacggattctttaaaggatgtcttgcggccatgtgctgctgttgtgccctggacatctgcttctaaggagatacaataacattggaatggttttatctacgaagagttgtgtgaatgtcatgtgaattattattctctctagccttattgtaaaaagaaacattctgttattgttttattggatttcctgtaagacttgtgtttttccattcgaacatattatgtctttactctttatgaatttatggtacttttagttcatttctattgctcttgggtttgttgtacctttaaatcaaacgagaataaatatgattatcaac

SEQ ID NO: 376 - DNA, 504 bp, Brassica napus
ggcatttgtaaagatattcaaagatcaaaaacattctgatccatacaaagaaaacatcttcacacacacataaagctctggccttagatcaaatacgttacaactaatcgttcaaagatgagccagtacaatcacaaccaatcttcaggagttaaccctccaccacctatgtcaaccggtccatcgccaccaccaccgattggttacccgacggtcgaccctagtcatggttcggcagctcctgttaaagtcgagaccagttctaagggtgacggattctttaaaggctgtcttgcggccatgtgttgctgttgcgccctggacatctgcttctaaggagattagcgatattataacattggagtggttttatttacgacgagttgtgtgaatgtgatgtgaattgttctctctcgcctattgtttttgtaaaaaataaatattctattattggttattaatttcttgttagagatgggttttgtattcgaacatatggttagc

SEQ ID NO: 377 - DNA, 605 bp, Brassica napus
gcggacgcctgcggaccggtccggaawttcgggtcgagmacgcgtccgaaaacattcttgatccatacaaagagaacatctttacacacacgtaaaattcttgccttagatcaaagtcgttacactaatcgttgaagatgagccagtacaacaaccaatctgcaggagctaattctccaccaccgatgtcaaccggtccagcaccgccgccgccgatgggttacccgacgaacgacccgagtcatggttcggcggctcctgttaaagtggagaccaattctaagggtgacggattctttaaaggatgtcttgcggccatgtgttgctgttgtgccctggacatctgcttctaaggagatatataccataacactgggatggtttaaatttatttacgacgagttgtgtgaatgtcatgtgaattattctctgtagccttattgtaaaacgaaatattctgttattgttttattgatttcctgtaagacttgtgttttttcattcgaacatattatgtctttactctttttgaatttatggtacttttagttcattttctattgatctmtygggtttgwgtaccttaactcaaacgagaataatgt

SEQ ID NO: 378 - DNA, 519 bp, Raphanus sativus
ggtgattcaaagatcaaaatcattcttgatccatacaaaagaaaacatatacacacataaaactcttgctttcgaattcaaattcgttacactaatcgttggaagatgagccagtacaatcacaaccaatttgcaggagctactaacccttcaccaccgatgtcaaccggcccagcgcccccagctccgattggttacccgacgaacgacccgagtcatggttcggcggctcctgttaaagtcgagaccaactctaagggtgacggattctttaaaggctgtcttgctgccatgtgttgctgttgtgccctggacatctgcttctaaggagatgcaatataactttggaatggttttatttacgagttgtgtgtgaatgttatgtgaattgtttttccctagcctttttgtgtataaaataataattctattattggtttattgattcttgtaagacgtgttttgttattcgaacatatttttatagtctttatagtccttatgaatttctgatctttt

SEQ ID NO: 379 - DNA, 578 bp, Thellungiella halophila
ccattcttgatccattaaaaaaacatcaatacacatacacataacatcttgccttagatcaaatttcgttacactaatcgttctaagatgagccagtacaacaatcacaaccaatctgcaggagctaaccctccaccaccgatttcaaccggcggaccgcaaccaccgatcggttacccgacgagcgacccgagtcacggttcagtggctcctgttaaagccgagaccaagtctaagggtgacggcttcttcaaaggctgtcttgcggccatgtgttgctgttgtgccctggacatctgcttctaaggagttacaataacattggaatggttttatttacgacgacttgtgtgaatgtgatgtgaattattctcttcagccttattgtataaaatattatattattggtttgtgaaatccttgtaagacttgttgggtttttattcgaaggcttatgggttatttttttccgaaccatattagttttatattttatctttgaatctcttgtattttaaattcatttatcttgccctcagttttgtatcttcaatcaaagggataatatataaaattag

SEQ ID NO: 380 - DNA, 1380 bp, Hordeum vulgare
cgcgacgccaaccaccttccactactcctacactcccacacactacagctcgtacgtcgccgcttcccctcccccgcccgcggccgctgctataactacaggccacggagcgccagcgagggggcaaccctagctaggcttcgcgggaggagctatggcgagcggcagcggcgaggggaaggcgggccgggccggcgcggggtaccagcagtacgcctcgtacggcaccggcaccggctacgacgagcgccagtggtggccgtggctcgtgcccaccgtgctcggcgcctgcgtctcggtcttcgccgtcgagatgtacctcaacgactgcccccgccacgggagcaccctcggcggcgacgcgccctgcgtcgccggtttcctccgccagttctccttccagccgctccgcgagaacccgctcctcggcccctcttccgccactttggagaagatgggagctcttgactgggccaaagttgttcatcaacaccaatggtggcgcctattcagttgtgtctggctccatgctggcctaattcacttgattgtcaacatgatgagcttgctattcataggaatccgccttgaacaacaatttggctttgtccgcattgggatcatctacctgctatctggctttggtggaagtgttttgtctgcactgttcttacgtaatcactacatctctgttggtgcctctggagctttgtttggcctacttggctctatgctatccgagcttattatgaactggaccatttattccaacaaggcagcagccatcacaactctccttttcataattgcaatcaatctggcaatcgggatactaccgcatgctgataattttgcgcacattggtgggttcgtgtccgggttcctttttggatttgtgctgctagcaaggcctcaatttggttggatggaacgccatgagttgcctcagaccgatcaacccccaaagtacaagatgtaccagtatgctctgtggggcgcggcactgctctttctgctggttgggtatgtggtcggcctggcgatgcttttcaagggaaagaacggcaacgatggctgccactggtgccggtacctgaactgcgtgcccacgtccaggtggaagtgcagcacttagatatgattcagttcccccgttgaaatacatcaactctccggagagccatttttattgtgtgtttacagataccaacatcacaggcttgtgcctcgcagagctgaatccctcctgtatcgtgcgtgacgatgtaatttgagttcgtacctgttggcctcagcatgattctgcatcgaccgtacctctagatcttgtcactgtatgctgattttttaaataaaaaaaatcctcgcaagcaattcatc

SEQ ID NO: 381 - DNA, 1428 bp, Hordeum vulgare
  misc_feature (1395)..(1395): n is a, c, g, or t
  misc_feature (1426)..(1426): n is a, c, g, or t
ctaccctgtccctgacagagcgagccagcgccactcgactccagctagcctcgtccttccttccttccttccttccccgtccatccttggcttgcacatcacatcacgccacggaagctacgagcgcgtgaggcgggagcgggagcgggcatggaggggggcggcgaggggaagggccgggcggcgacggcggcggggggaggagggttcggcgggtacgagtcggccggggaccgaaagtggtggccctggctcgtgcccaccgtcatcgtcgcctgcgtcgccgtcttcgtcgtcgagatgtgggtcaacgactgccccaggcacggcagcgcgctcggcggcggctgcgtcgcgggtttcctccgacgcttctccttccagccgctccgcgagaacccgctcctcgggccatcctccaccactttggggaaaatgggagctcttgactggaacaaggtcgtccatcagcaccaggggtggcgtctcattagctgcatctggctccatgctggtctcatccatttggttgtgaacatgctaagtctgctgtttattgggattcgtcttgagcagcaatttgggtttgttcgcattggtgccatctacctactgtctggtttcggtggcagcgtaatgtccgcacttttcctacggaataactacatctccgttggtgcatcgggagctttatttgggctgcttggttctatgctttctgagctacttatgaactggaccatttactccaacaaggttgcagccataataactcttctgtttataatcgcgatcaacgtggcgattgggatactgccgcatgctgataactttgctcatattggtggattcttgaccgggttccttttggggtttgttctgttggcaaggccacaatttggttggttggaacgcagtgagctgccccatactaatcagcctcccaagtacaaaccataccaatatgtcctgtgggttgtggcattcgtcttgctgcttgtcgggttcacgatttcattggtgatgctcttcaagggcaagaacgggaacgacggctgccactggtgccactacctgaactgcgtgccgacgtcgaggtggaagtgcgatacctaggcggttccttctttcggttttcgacgaaaacaagtagtgttgggaggaccattttcatgcttgtatgtttgtagataggaactgtggtctgtcgattatgtttgttctttagcgaatcctgtatatttgtttgccaggccgtgtaagtttgtaactcgagcactctccagtgatttcctgcatgttgttgtgtaaaaggccatatcgtttttgatccttgctttcgtgttgggccaggcagtcgaacagtgtggcgcttgacgtgctagataacagatnataactagaaggtcgaaatgttgacatgcangg

SEQ ID NO: 382 - DNA, 1102 bp, Brachypodium distachyon
gccacggcaaccaccgtcccactactgggctcccctcccacactcactcccactctctccgcttcccccgcggctgctataactgcagctggctgaggagcctaggaacctagcaggcgcgagaggggaagatggcgaacggcggcggcgaggggaaggcgggcgcggggtaccagtacgggccgtacggcgtggtgcgggaggagaggcagtggtggccgtggctcgtgccggccgtgctcggcgcgtgcgtcacggtgttcgccgtcgagatgtacaacaacgactgcccgcgccacgggagcacgctgggcggaggcgacgcgccctgcgtcgccgggttcctccgacgcttcgccttccagccgctccgcgagaacccgctcctcggcccctcctccgccactttggaaaaattgggagctcttgactgggccaaagttgttcatcagcaccaagggtggcgcctcatcagctgtatctggctccacgctggcctaatccatttgattgtcaacatgctgagcttgctattcattggaatccgcctcgagcagcaatttgggtttgtgcgcattgggatcatctacttgctatctggctttggtggcagtgtgctctctgcactgtttttaaggaatcactacatctctgttggcgcctctggagctttgtttggcctacttggctctatgctctctgagcttattatgaactggaccatttattccaacaaggcagctgccatcataactcttctgtttataattgtgatcaatttggcaatcgggatactaccacacgctgataactttgcgcacattggtggatttgtgagtggatttcttattggctttgtgctgctggcaaggcctcaatttggttggatggaacggaacgagttgccccagactgatcaacctccaaaatacaaaacataccagtatgttctgtggggcgtggcactcctcttgctgctagttggatatgtggttaccctggcattgcttttcaagggcaagaacggcaacgatggctgccactggtgccggtacctgaactgcgtgccgacatccagatggaagtgcggcacctagacggt

SEQ ID NO: 383 - DNA, 1194 bp, Brachypodium distachyon
tcgactcgagtctcgagctttccttctccgcgttccttggcttggcttgcacaccaccgaagcgaccacgcgagggagaaagaggggagcggcatggaggggaacggcgaggggaagggccgggcgccggggccggcggcgacggcggcggggggcgggggaggagggtacggctacggcgggtacgacggggccggcggggacaggaagtggtggccgtggctcgtgcccaccgtgatcgtcgcgtgcatcgcagtcttcgtcgtggagatgtgggtcaacgactgccccaggcacggcagcgccctcggcggcggctgcgtcgtcggcttcctacgccgtttctccttccagccgctccgcgagaacccgctcctcggcccgtcgtccgccactttgggcaaaatgggagctcttgactggaacaaggtcgttcatgagcaccaagggtggcgtctcatcagctgtatctggctccatgctggtctaatccatttggttgtgaacatgctaagtttgctgtttattggaattcgtcttgagcagcaatttgggtttgtccgtattggtgccatatacctattatctggttttggcggcagcgtgttgtctgcacttttcctacggagtaactacatctcagttggtgcatctggagctttatttggacttcttggatctatgctttctgagcttatcatgaactggaccatttattccaacaaggtagcagccataataactcttctgtttataatagcgatcaacatggcaattgggatcctacctcatgctgataactttgctcatattggtggatttgtgacgggcttccttttgggatttgttttgctggcgaggccccaattcggttggatggaacgcaatgagttgccccataccaatcaacctcccaagtacaaagcataccaatatgttctatgggttgtggcactcctattgctgcttgtcggatttgtgacttcattggtgatgctcttcaagggcaagaacgggaatgacggctgccactggtgccactacctgaactgcgtgccgacatcgaagtggaagtgcaatacctaggcagttgttctccagttttcgaccaaatacacagtgtttggaggactcttttcaggcttgtatttttgtagatacgaacgtgttcgtccattatgtttgttctttagc

SEQ ID NO: 384 - DNA, 1253 bp, Festuca arundinacea
ggcacgaggcttcttccccatcctcccacacatcctctcccctgccttccacaccacaccacacctcacaccgccgagccagaatcatggacgcgaacggcgcggagaagggccgggcggcgccggcgccggcggggggtggcggggcgtacgggggctacgagggcgccggggaccgcaagtggtggccctggctcgtgcccaccgtcatcgtcgcctgcatcgccgtcttcgtcgtcgagatgtgggtcaacgactgccccaagcacggywccgcgctcggcscsggscagccctgcgtcgcgggmttcctcaggcgmttctccttccagccgctccgcgagaacccgctsctcggcccstcmtcagccactttggcgaaaatgggagctcttgactggaacaaagtcgtccatcagaaccaaggctggcgcctcattagctgcatctggctccacgccggcctaatccatttgcttgtgaacatgctaagcttgctgttcattgggattcgtcttgagcagcaatttgggtttgttcgcattggggccatctacctactgtctggtttcggtggcagcgtgctctctgcgcttttcctacgaaataactacatctctgttggtgcatctggagctttatttgggctgcttggttctatgctttctgagctacttatgaactggactatctattccaacaagattgcagccataataactcttctgtttataatcgtgatcaacgtggcaatcgggatactaccacatgccgataactttgctcatattggtggattcatcgccggcttctttctgggttttgttctgctggcaaggccccaatttggttggatggaacgcagtgagttgccacatactaatcagcctcccaagtacaaagcataccaatatgttctgtgggttgtggcgctcgtcttgctgcttgtggggttcatactttcgctggtgatgctcttcaagggcaagaatgggaacgatggttgccactggtgccactatctgaactgtgtgccgacgtccaagtggaagtgcgatacctaggcagtttcttcttcagtttaccgttcagttttcagcgagatatgtagcatgtggaggaccattttcatgcttgtatgtttgtagatatgaactgcagccgtcgattacgtttgttctttagcgaattatgtaaatttgtttgtcacgcactttaattttataaaaaaaaacctgcccgggcggccgtcc

SEQ ID NO: 385 - DNA, 1198 bp, Leymus cinereus x Leymus triticoides
cactactcctacagtcccacaccacagcttgtagtacgttgccgcttcccctcccccgcggctgctcctataactacaggccgcggagcgcgagcgaggggsgcaaccctagctagacttcgcgagaggggcyatggcgagcggcagcggcgaggggaaggcgggccgcgccggcgcggggtaccascagtacgcctcgtacggcaccggctacgacgagcgccagtggtggccgtggctcgtgccyaccgtgctcggcgcctgcgtctcggtgttcgccgtcgagatgtacgtcaacgactgcccccgmcacgggagccccctcggcggcgacgyggcctgcgtcgccggmttcctccgccagttctccttccagccgctgcgcgagaacccgctcctcggcccctcttcggccactttggagaagatgggagctcttgactgggccaaagttgtycatcaacaccaatggtggcgyctattcagctgtatctggctccatgcyggcctaattcacttgattgtcaacatgatgagcttgctattcataggaatccgccttgaacagcaatttggctttgtccgcattgggatcatctacctgctatctggctttggtggaagtgtkctstctgcactgttcttacgtaatcactacatctctgtyggtgcctctggagctttgtttggcctacttggctctatgctctctgagcttattatgaactggaccatttattccaacaaggcagcagccatcataactcttctgttcataattgcaatcaatctggcaatcgggatactaccgcatgctgataattttgcgcatattggtggrttcgtatctggattcctttttgggtttgtgctgctgrcaaggcctcaatttggttggatggarcggcaygagttgccycagaccgatcaacccccaaagtacaaracktaccagtatgttctgtggggcgcggcactgctcttgctgctggttggstwtgtggtyggcctggcgatgcttttcaagggaaagaacggcaacgacggctgccactggtgccggtacctgaactgcgtgcycacrtccmggtggaagtgcagcacttagayatggttcagttccccgttyggcgtttctccgaaatacatsaactctccggagaaccatttttatgcttgtgtgtttacagataccaac

SEQ ID NO: 386 - DNA, 1725 bp, Zea mays
aggacctgcagctctcagctcacctctgtccgggctccttcctcctcactcagacgcagagcattactccgcgtcttcgccccaccccacagggcactaggactagctcctcccaagtgaacccaaccgctccatccgcggacagcaacgtctgaccgcccagtggtcccgacactcccaggggcccagcgcgccagcctgactgcggcccacccaccgcaggccttgacgggcaccatttctcctctcgccagctttgcccctctctttcctcacttccaagcgacacccgaaggccacagcggcacagcgccagcggcaacagtcaccagaccaccactaccagtctaccacccacctgacctgagcgaccccttcgcttccactccactgaagcgggccaaaagaaggaaagaaggcgggcaagcgacaggaaggaggaggaggaggaggaggagaagccatggcgagcgacggcgacgggaagggccgggtcgcgacggcgccgggggcaggagggtacggctacggctacggctacgccggcttcgagggggaggaggaccggaagtggtggccgtggctggtgcccaccgtgatcgtcgcatgcatcgccgtcttcgtcgtcgagatgtacgagaacaactgccccaagaaccggagccagctcggcggcgactgcgtcgccggcttcctccgccggttctccttccagccgctccgcgagaacccgctgctcgggccgtcctcctccactttggagaaaatgggagctcttgactggaataaaattgttcatcaaaaccaagggtggcgccttattagctgcatctggctccatgctggcctaattcatttggttgtgaacatgctaagtttgctgtttattggaatccgtcttgagcagcaatttggatttgttcgcattggtgccatatacctactgtctggttttggtggcagcgttctgtctgcactcttcctacggaataactacatctctgttggtgcttctggagctttatttggcctgcttggatccatgctttctgagctactcatgaactggactatatactccaacaaggcagcagctataataacactcctgtttataattgcactcaacttggctattgggatactacctcatgctgacaactttgctcacattggtggattcgcaacgggtttcctcttgggttttgttctgttggcaaggcctcaatttggctggatggaacaccacgagctgccgcagactaaccaacctcccaagtacaaagcgtaccagtatattttgtgggttgtggcactagtcttgctgttagttgggtttgtgatttcacttgtgatgcttttcaaagggaagaacgggaacgacggctgccactggtgccactatctaaactgcgtgccaacatcaaagtggaagtgcaacacctagacacctcaggtttctgttactctggcgaaacatgtagtattcagattcagaagaccattttttttatgcgtgtttgtctgtagatataaacaagttctttgttctttactgggttgaagttatgtaaactgctttgttgagctttgtatgtttataactcgaggttgatgcctattcaaaatcgttgtttagaatgctcgtatcttatttttgtttatcaaggtatgctgcagctttgaattgttggaatcagctaatataacaaaacaattataact

SEQ ID NO: 387 - DNA, 1465 bp, Zea mays
cgcactcacaccatttcaccatctctccgcggaagcagatcctctccgctcgccagcctccccctcctgctgctgcctcctcgcttcaagcaacacccgaagcggcaacaaccaccaccaccaccaccaccggacctgcctgagcgaccccttggcttcccactccactgaagcagggcgagagagagtaaggaggaggaggagaagccatggcgagcgacggcgacggtaagggccgcgtcgctacggcgccgggggcagggtacgggtacgcggcgtacggcggctaccagggggcggaggagcggaagtggtggccgtggctcgtgcccaccgtcatcgtcgcctgcatcgccgtgttcgtcgtcgagatgtacgagaacaactgccccaagcacgggagccagctcggcgactgcgtcgccggcttcctccgccgcttctccttccagccgctccgcgagaacccgctgctcggcccgtcctcctccactttggagaaaatgggagctcttgactggaataaaattgtccatcaaaaccaagggtggcgccttattagctgcatctggctccatgctggcctaatccatttggttgtgaacatgctaagtttgctgtttattggaatccgccttgagcagcaatttggatttgttcgcattggtgccatatacctactgtctggttttggtggcagcgtgttgtctgcactcttcctacggaacagctacatctccgttggtgcttctggagctctatttggcctgctgggatccatgctttctgaactactcatgaactggactatatactccaacaaggcagcagctataataacactgttgtttattattgcactcaatttggctattgggatactacctcacgttgacaactttgctcacattggtggattcgcgacgggtttcctcttgggttttgttctgttggcaaggcctcaatttagctggatggaaagtcatgagttgccacacactaaccaacctcccaagtacaaagcataccagtatattttgtgggttgtggcactcgtcttgctgttagttgggtttgtgatttcactggtgatgcttttcaaagggaagaacgggaacgatggctgccattggtgccactacctgaactgcgtgccaacatccaagtggaagtgtaacacctagacacctcagttttctgtacactcgggggcaaaaatgtagtatccagatttacaagaccattctctatgtttgtttgtctgtagatatgaacaagttctttgttgtttactggatttgagtttccttgcctatgtaaactgcttcgttgagcgttctatgtttataattggagtttgatagctgttttaaattgctcaatggaaaagcagtagctttggtgcgcagttgatcgtggtgtttacacaaataaaaatacgataattttttatctaacagataac

SEQ ID NO: 388 - DNA, 1417 bp, Zea mays
ccactaccccgcacgctataactgcaaccagcgtagcgtaggctcgcggcggccgccgacaactcgggcgggacacgggagacagccatggcgacgggcggccaggggaaggccgcgggctactaccagtacccgacatcgtacgccggtgctgcggacgaggagcgccggtggtggccgtggctcgtgcccaccgtgctcgtcgcctgcatcgcggtcttcgccgccgagatgttcgtcaacgactgcccgcgccacgggagcacgctcggcggcggcgccgggtgcgtggcggccggtctcctccgccggttctccttccagccgctccgcgagaacccgctcttcgggccttcctccgccaccttggagaagatgggagctctcaactgggccaaagtagttcatgagcaccaagggtggcgcctcattagctgtatctggctccatgctggcctagttcacttggttgtcaacatgctaagcttgctcttcattggaatccgccttgagcaacaatttgggtttgtgcgcattggtgtcatctacttgatatctggctttgggggcagtgtgttgtctgcacttttcttacacagtaactacgtctctgttggtgcctctggggctttgtttggcctccttggatctatgctttcagagcttattataaattggactatctattccaacaaggcagcggcaatcataactctactttttataattgtaattaatctggccattgggatattacctcatgctgataattttgcccacattggtggatttgcttctgggtttcttattggatttgtgctgctggcaagacctcaatttggttggatggaacgcagcgagctacctcagactagtcaacctccaaagtacaaatcgtaccagtatgtcttgtgggttgctgcactcctcttgctggtagttgggtttgccattatcttggtcatgctcttcacgggtaagaatgggaacgacagctgccactggtgccattacctgaactgcgtaccaacgtccagatggaagtgcgatacctgaattccgcaaagtatatgctccactggtgttcgtgtgttcgtggaaatgtacgaccaaatgtatcctccacttgaccatcctgcgcttcttttgcccggattctccctggttccatgaaatacaaatgttccagaattgtagcacgagcttgtaactgttgatttcggcataattgatgtattcatctcaccaaactctatagcaccaccttgataattttagacggccaatctaaagtattcagattttgcgagtgtccacgcactgacgatttcagccgaaagatcggtaaagttcaattgcatatgatggcactatgctgacggtttgtttgaagctctgaattgaggtgcatttggcc

SEQ ID NO: 389 - DNA, 1248 bp, Pseudoroegneria spicata
  misc_feature (1229)..(1231): n is a, c, g, or t
gcttgcacatcacatcacgtcaccggagccatttacgagcgcgtgagaccagcagcgggagcatggaggggggcggcgaggggaagggccgggcggcggcggcgacggcggcggggggagggttcggcgggtacgagtccgccggggaccgcaagtggtggccctggctcgtgcccaccgtcatcgtggcctgcgtcgccgtcttcgtcatcgagatgtgggtcaacgactgccccaggcacggcagcgcgctcggcggcggctgcgtcgcagggttcctccgacgcttctccttccagccgctccgcgagaacccgctcctcgggccctcctccaccactttgggtaaaatgggagctcttgactggaacaaagttgttcatcagcaccaagggtggcgtctcattagctgcatctggctccatgctggtctgatccatttggttgtgaacatgctaagcctgctgttcattggaattcgtcttgagcagcaatttgggtttgttcgcattggtgctatctacctactgtctggtttcggtggcagcgtaatgtccgcacttttcctacggaataactacatctccgttggtgcatcaggagctttatttgggctgcttggttctatgctttctgagctacttatgaactggactatttactccaacaaggttgcagccataataactcttctctttataatcgcgatcaacgtggcaatcgggatactaccacatgctgataactttgctcacattggtggattcttgaccgggttccttttggggtttgttttgctggcaaggccacaattcggttggttggaacgcagtgagctgccccatactaatcagcctcctaagtacaaaccataccaatatgtcctgtgggttgtggcactcgtcttgctgcttgtcgggttcacgatttcgttggtgatgctcttcaagggcaagaacgggaacgacggctgccactggtgccactacctgaactgcgtgccgacgtcgaggtggaagtgtgatacctaggcggttccttctttcagttttcgacgaaaacgcatagtgtggggaggaccattttcatgcttgtatgtttgtagataggaactgtggtctgtcgattatgtttgttctttagtgaattatgtaaatttgtttgccaggccctgtaagtttgtaactcgagcactctccagtgatttcctgcgtgtttttgtgtaaaannnccatatcgttttgatca

SEQ ID NO: 390 - DNA, 1259 bp, Pseudoroegneria spicata
ggagcgccagcgaggggggcaaccctagctagctagacttcgcgcgcgtgttaggggccatggcgagcggcagcggcgaggggaaggcgggccgcgccggcgcggggtaccagcagtacgcctcgtacggcaccggctacgacgagcgccagtggtggccgtggctcgtgcccaccgtgctcggcgcctgcgtctcggtcttcgccgtcgagatgtacctcaacgactgcccccgccacgggagccccctcggcagcgacgcgccctgcgtcgccggcttcctccgccagttctccttccagccgctgcgcgagaacccgctcctcggcccctcttcggccactttggagaagatgggagctcttgactgggccaaagttgttcatcaacaccaatggtggcgcctattcagctgtgtctggctccatgctggcctaattcacttgattgtcaacatgatgagcttgctattcataggaatccgccttgaacagcaatttggctttgtccgcattgggatcatctacctgctatctggctttggtggaagtgtgctgtctgcactgttcttacgtaatcactacatctctgtcggtgcctccggagctttgtttggcctgcttggctctatgctctctgagcttattatgaactggaccatttattccaacaaagcagcagccatcacaactcttctgttcataattgcaatcaatctggcaatcgggatactaccgcatgctgataattttgcgcatattggcgggttcgtatccggattccttttcgggtttgtgctgctggcaaggcctcaatttggttggatggaacggcatgagttgccccagaccgatcaacccccaaagtacaagacgtaccagtatgttctgtggggcgcggcgctgctcttgctgctggttgggtatgtggtcggcctggcgatgcttttcaagggaaagaacggcaacgacggctgccactggtgccggtacctgaactgcgtgccctcgtccaggtggaagtgcagcacttagatatggttcagttcccccttttggcgtttctccgaaatacatgagctctccggagaaccatttttatgcttgtgtgtttatacagataccaacgtcagagacttgtgcctcgcagagctgagtccctcctgtatcttgcttgacgatgtaatttgagttcgtacctcctgtcaaacgttcgccagctaagggggtaaaaaaaaaatcctcgcaagcaattcatca

SEQ ID NO: 391 - DNA, 1460 bp, Oryza sativa
aagccaagccaaaaacccctccacgagccgcgccgtacgccatcgccaaccaccactccactactacttccccccacactcactcactccactcccaccacagcaaccgcttgctttgcttcgcccatctgagctataattagctcgaggagagagccctaacccgccgcgccatggcgagcagcagcggcgaggggaagggtgccggcggcgcggggtaccagtacgcgccgtacggcgggtcgtactacgacgaggagcggcggtggtggccgtggctcgtgccgaccgtgctcgtggcctgcatcgtggtgttcctcgtcgagatgttcgtcaacgactgcccccgccacgggagcccgctccgcggcgagtcctgcgtcgccggcttcctccaccagttcgccttccagccgctccgggagaacccgctcctcgggccctcctccgccactttggagaagatgggagcactagactgggcgaaggttgttcatcagcaccaagcatggcgtctcattagctgtatctggctacatgctggcctaatccacctgattgtcaacatgctaagcttgctattcatcggactccgtcttgagcagcaatttgggtttgtgcgtattggaatcatctacttgctatctggctttggcggtagcgtgctgtctgtgctgtttttacgtaataactacatctccgttggtgcctctggagctttgtttggcttacttgggtctatgctctccgagcttattatgaactggactatttattccaacaaggcagcggcaatcataactctcctgtttataattgcaatcaatttggcgatcgggatactacctcacgctgataactttgcacacattggtggatttgtgactggattccttcttgggtttgtcctgctggcaagacctcaatttggttggatggaacgtcatgagttgcctcagactaatcaaccacgaaagtacagagcataccagtatgttttgtgggctgttgcactcttcttgctgctagttgggtttgtgattgccctggtgatgcttttcaaggggaagaatggaaacgatggttgtcactggtgccactacctgaactgcataccaacatccagatggaagtgcagtacttagatgcttcagaattccgttagctcttctccaaattacaaatattcttcgggaaccattttcaagcttgtgtgcttgtagatatctacaagaaatttgccacagagtcgaattctgccctttccaaagtgtagtacaattttctgctttgtaatttgagattgtaacagctgtttatttcagcccaactccatactgcattgctcaaaaaatttgtgatgttcaattggattctcttatatcatctaaagttcgaaacaatgttaatggttatggagtctaaacattcttctttcaaagtttcaaggccttctctgg

SEQ ID NO: 392 - DNA, 1324 bp, Sorghum bicolor
ccaccagtccactaccccgcacgctataactgtagccagcggaggcggaggcgcgcggcggcggccgacgacaactcagccagccatggcgacggggggcggccagcaggggaaggccgcggggtactaccagtacccggcctcgtactcgtacgccggcgccgcggccgcggccgcggaggaggagcgccggtggtggccgtggctcgtgcccaccgtgctcgtcgcctgcatcgcggtcttcgcggccgagatgttcgtcaacgactgcccgcgccacgggagcgcgctcggcggcggcgccgggtccgggtgcgtcgcggccgggctcctccgccggttctccttccagccgctccgcgagaacccgctcttcgggccttcctccgccaccttggagaagatgggagctctcaactgggccaaagtagttcatgagcaccaagggtggcgcctcataagctgtatctggctccatgctggtctagttcacttggttgtcaacatgctaagcttgctcttcattggaatccgccttgagcaacaatttgggtttgtgcgcattggggttatctacttgatatctggctttggcggcagtgtcctgtctgctcttttcctacacagtaactacatctctgttggtgcctctggggctttgtttggcctccttggatcaatgctttcagagcttattatgaactggactatctattccaacaaggcagcggcaatcataactctactttttataattgcaattaacctggccattgggatattacctcatgctgataattttgcccacattggtggctttgcttctggatttcttcttggattcgtgctgctggcaagacctcaatttggctggatggaacgcagcgagctacctcagactaatcaacctccaaagtacaaattgtaccagtatgtcttgtgggttgctgcactcctcttgctggtagttggatttgtgattatcttggtcatgctcttcaagggtaagaacgggaacgatagctgccactggtgccattacctgaactgcgtaccaacatccagatggaagtgcgatacatagcttgctatattctgcaaagtatatgcttcttgagggagcagattttttttattttttatttttattttttttatgttggtgtgtttgtggaaatgtacgacgaaatgtgtcctcctccacctgaccatcctgcacttgtgccctaattctccctggttctttgaagtacaaatgtttcagaattgtagctcgagcttgtaactgttgatttcagcgcaattgctatatttgattctctca

SEQ ID NO: 393 - DNA, 1420 bp, Sorghum bicolor
ccacttcatcatctctcgccgctggccttcccctgctgcctgcctgcctgccttcctcgcttccaagcgacacccatccgaagcggcagcgagcggcaacagccaacagccaccaccaccacctgagccgctgagcgacgaccccttggcttccactccactgaagcaggcgaaaaaggagggaagcaagcgggcaggcgtgaggaaggaggaggaggaggagaagccatggcgagcgacggcgacgggaagggccgcgtcgcgacggcgccggggggagggtacgggtacgggtacgggtacggcggctacgaggggttcgaggaccggaagtggtggccgtggctcgtgcccaccgtgatcgtcgcctgcatcgccgtgttcgtcgtcgagatgtacgagaacaactgccccaagaacaggagccagctcggcggctgcgtcgccgggttcctccgccgcttctccttccagccgctccgcgagaacccgctgctcgggccgtcatcctccactttggagaaaatgggagctcttgactggaataaaattgttcatcaaaaccaagggtggcgccttattagctgcatttggctccatgctggcctaatccatttggttgtgaacatgctaagtttgctgtttattggaatccgccttgagcagcaatttggatttgtccgcattggtgccatatacctactgtctggttttggtggcagcgtgttgtctgcactcttcctacggaacaattacatctctgttggtgcttctggagctttatttggcctgcttgggtccatgctttctgagctactcatgaactggactatatactccaacaaggcagcagctataataacactcctgtttattgttgcactcaacttagctattgggatattacctcacgctgacaactttgctcacattggtggcttcgcgacgggtttcctcttgggttttgttctgttggcaaggcctcaatttagctggatggagcgccatgagttgccacagactaaccaacctcccaagtacaaagcgtaccagtatattttgtgggttgtggcactcgtcttgctgttagttgggtttgtggtttcactggtgatgcttttcaaagggaagaatgggaacgatggctgccactggtgccactacctgaactgcgtgccaacatctaagtggaagtgcaacacctagacacctcagttttctgttacactctccggcgaaacatgtagtattcagattcagaagaccattttttatgtttgtttgtctgtagatatgaacaagttctttgttctttgctgggttggagtttcctggtctttgtaaactgttttgttgacggttgtatgtttataactcgagcttgatacctgttcaaaattgttgtttagaatgtcagtgt

SEQ ID NO: 394 - DNA, 1809 bp, Saccharum officinarum
acaccatttcatcgtctttcgccagccttcccctcctgcctgcctcctcgcttccaagcgacacacccgaagcggtcgcgagcggcaacagccaccaccaccgccagcctgacgcgctctcggccgcaccgcacccacaccatttcatcatctttcgccagccttcccctcctgcctgcctcctcgcttccaagcgacacacccgaagcggtcgcgagcggcaacagccaccaccaccgcctgagccgctgagcgaccccttggcgtccactccactgaagcgggccaaaaggaggaaagcaagagggcaggcgtgaggaaggaggaggagaagcgatggcgagcgacggcgacgggaagggccgcgtcgcgacggcgccggggggagggtacgggtacgggtacgggtacggcggctacgagggcccggaggaccggaagtggtggccgtggctcgtgcccaccgtgatcgtcgcctgcatcgccgtgttcgtcgtcgagatgtacgagaacaactgccccaagcacgggagccagctcggcggctgcgtcgccgggttcctccgccggttctccttccagccgctccgcgagaacccgctgctcgggccgtcatcctccactttggagaaaatgggagctcttgactggaataaaattgttcatcaagaccaagggtggcgccttattagctgcatctggctccatgctggcctaatccatttggtcgtgaacatgctaagtttgctgtttattggaatccgccttgagcagcaatttggatttgtccgcattggtgccatatacctactgtctggttttggtggcagcgtgttgtctgcactcttcctacggaacaactacatctctgttggtgcttctggagctttatttggcctgcttgggtccatgctgtctgagctactcatgaactggactatatactccaacaaggcagcagctataataacactcctgtttattattgcactcaacttagctattgggatactacctcacgttgacaactttgctcacattggtggattcgcgacgggtttcctcttggggtttgttctgttggcaaggcctcaatttagctggatggagcgccatgagttgccacagactaaccaacctcccaagtacaaagcataccagtatattttgtgggttgtggcactcgtcttgctgttagttgggtttgtgatttcactggtgatgcttttcaaagggaagaatgggaacgatggctgccactggtgccactacctgaactgcgtgccaacatctaagtggaagtgcaacacctagacacctcagttttctgttactccggcgaaacatgtagtatttagattcggaagaccattttttatgtttgtttgtctgtagatatgaacaagttctttgttctttactgggttggagtttcctggtctctgtgaactgctttgttgacggttgtatgtttataactcgagcttgatacatgttcaaaattgttgtctatgtcaaaaaacctaacgttatagctagtagtacattgaaaaattctacggtctgtttgggcggcgtttcttaaggatcgaaccttacgtacgcgagactgcaagatattatatgctctattgggtgacataaagacatttctgtggacgatcttttacaacagtctgtattgggaaaaccatgtctgttcccaacttattcgccttggcgccatacaaatttagaagctgatgaatagacatgaggcctgctcctatcggcctttttagagtagtccactcttaatggcaattggga

SEQ ID NO: 395 - DNA, 1294 bp, Panicum virgatum
ctcgcttccaagcgacaccaaaagcggcagcgagcggcaagaaccaccaccaccaccacttgagcctccccttggcttccactccaccgaaccagaccggaaaggcggaggcggggcaggccagaggccatggcgagcaacggcgacgggaagggccgcgtggcggcggcggccgggggagggtacgggtacgggtacggcgggtacgaggggcccgaggagcgcaagtggtggccgtggctcgtgcccaccgtcatcgtcgcctgcatcgcggtcttcgtcgtcgagatgtacgagaacaactgccccaagcacgggagccagctcggggactgcgtcgccggctttctgcgccgcttctccttccagccgttccgggagaacccgctcctcgggccctcgtcctccactttggagaaaatgggagcccttgactggaacaaaattgttcatcagcaccaaggctggcgccttattagctgcatctggctccatgctggcctaatccatttggttgtgaacctgctgagtttgctgtttattggaatccgccttgaacagcaatttggatttgttcgcattggtgccatatacctactatccggttttggtggcagcgtgctgtctgcactcttcctacggaacaactacatctctgttggtgcatctggagctttatttggcctgcttggatccatgctctcagagctactcatgaactggactatttattccaacaaggcagcagccataataactctcctgtttattatcgcgctcaacttggctattgggatactacctcacgcagacaactttgctcatattggtggattcgctactggcttcctcttgggctttgttctgttggctaggcctcaatttggttggatggagcgccatgagttgccagagactagccaacctcctaagtacaaagcataccaatatgtgctgtgggttttggcactcgtcttgctattggttgggtttgtgatttcactggtgatgcttttcaaggggaagaatgggaacgatggttgtcactggtgccactacctgaactgcgtgccaacatcgaagtggaagtgcaacacctaggcgcctcagttttccacttacacttccgacgaaatgtgtagtgttcagattcagaagaccattttttatgctgtttgtatgtagatatgaacaagttctttgttctttattggattggactttcctggtttctgtaaactactttgttaagccttgcgtgtttataaatcgaggttgataccttttcaagctt

SEQ ID NO: 396 - DNA, 1321 bp, Panicum virgatum
agcctcctcacctcgcttccaagcgacaccagaattggcagcggcaacagccaccaccacagccgcaccacttgagcttcttccccttggcttccactccactgaaccgggccggaaaggcgggggcggggggcaggcgcgagaggccatggcgagcaacggcgacgggaagggccgcgtggcggcggcggcggcgcccgggggagggtacgggtacgggtacggcgggtacgaggggcccgaggagcgcaagtggtggccgtggctcgtgcccaccgtcatcgtcgcctgcatcgcggtcttcgtcgtcgagatgtacgagaacaactgccccaggcacgggagccagttcgggggctgcgtcgccggcttcctgcgccgcttctccttccagccgctccgggagaacccgctcctcgggccgtcatcctccactttggagaaaatgggagcccttgactggaacaaaattgttcatcagcaccaaggctggcgccttattagctgcatctggctccatgctggcctgatccatttggttgtgaacatgctaagtttgctgtttataggaatccgccttgaacagcaatttgggtttgttcgcattggtgccatatacctactatccggttttggtggcagcgtgctgtctgcactcttcctacggaacaactacatctctgttggtgcatctggagctttatttggcctgcttggatccatgctctcagagctactcatgaactggactatttattccaacaaggcagcagccataataactctcctgtttattattgcgctcaacttggctattgggatactacctcacgcagacaacttcgctcatattggtggattcgctactggcttccttttgggctttgttctgttggctaggcctcaatttggttggatggaacgccatgagttgccacagactagccaacctcctaagtacaaagcataccaatacgtgctgtgggttgtggcattcgtcttgctattggttgggtttgtgatttcactggtgatgcttttcaaggggaagaatgggaacgatggctgtcactggtgccactacctgaactgcgtgccaacatcgaagtggaagtgcgacacctaggcgcctcagttttccactcacacttccgacgaaatatgtagtgttcagattcagaagaccattttttatgctgtttgtctgtagatatgaacaagttctttgttctttattggattggactttcctggtttctgtaaactactttgttgagccttggcgtgtttataaatcgaggttgataccttttcaagatta

SEQ ID NO: 397 - DNA, 1421 bp, Triticum aestivum
ctcctccttccttccccatccttccatcctcggcttgcacatcgcatcacgtcaccggagccagctacgggcgcgtgggacagcatggaggggggcggcgaggggaagggccgggcggcgccggcggcggggggagggttcggcgggtacgagtcggccggggaccgcaagtggtggccctggctcgtgcccaccgtcatcgtcgcctgcgtcgccgtcttcgtcgtcgagatgtgggtcaacgactgccccaggcacggcagtgcgctcggcggcggctgcgtcgcgggcttcctccgccgcttctccttccagccgctccgcgagaacccgctcctcgggccctcctccaccactttggggaaaatgggagctcttgactggaacaaagttgtccatcagcaccaagggtggcgtctcattagctgcatctggctccatgctggcctaatccatttggttgtgaacatgctaagtctgctgtttattgggattcgtcttgagcagcaatttgggttcgttcgcattggcgctatctatctactgtctggtttcggcggcagcgtaatgtccgcacttttcctacggaataactacatctctgttggtgcatctggagctttatttgggctgcttggatctatgctttctgagctgcttatgaactggacaatttattccaacaaggttgcagccataataactcttctgtttataattgcgatcaacgtggcgatcgggatactaccgcatgctgataactttgctcatattggtggattcttgacggggttccttttggggttcgttctgctggctaggccacaattcggttggttggaacgcagcgagctaccccatactaatcagcctcctaagtacaaaccataccaatatgtcctgtgggttgtggcactcgtcttgctgcttgtcgggttcacgctttcgttggtgatgctcttcaaaggcaagaacgggaatgacggctgccactggtgccactacctgaactgcgtgccgacgtcgaggtggaagtgcgatacctaggcggtcccttctttcggttttcgacgaaaacgcgtagtgttgagaggaccattttcatgcttgtatgtttgtagataggaactgtggtgttaattaagtttgttcgttagcgaattctgtaaatttgtttgccaggtcctgtaagtttgtaattcgagcacctctccagtgatttcatgcgtgtttttgtgtaarargccswatcsktttgatcctggcttttgcgttggcccgggagcccaattccaccattcctggtgccccttggaccccctttgaaaccaaaaaaaattaacgctggtggaatgggtaaatccccccaacaatcaatcaaaactattaaatttgtgggggggcccctcctatgtctaccc

SEQ ID NO: 398 - DNA, 1362 bp, Triticum aestivum
cgacgccaaccaccttccactactcctacactcccacacactacagctcgtacgtcgccgcttcccctcccccggcccgcggccgctgctataactacaggccacggagcgccagcgaggggggcagccctagctagctagaccagacttcgcgcgcgcgttagggaccatggcgagcggcagcggcagcggcgaggggaaggcgggcagggcgggcgcggggtaccagcagtacggcaccggctacgacgagcgccagtggtggccgtggctcgtgcccaccgtgctcggcgcctgcgtctcggtcttcgccgtcgagatgtacctcaacgactgcccccgccacgggagccccctcggcggcgacgcgcgctgcgtcgccggcttcctccgccagttctccttccagccgctgcgcgagaacccgctcctcggcccctcttcggccactttggagaagatgggagctcttgactgggccaaagttgttcatcaacaccaatggtggcgcctattcagctgtatctggctccatgctggcctaattcacttgattgtcaacatgatgagcttgctattcataggaatccgccttgaacagcaatttggctttgtccgcattgggatcatctacctgctatctggctttggtggaagtgtgctatctgcactgttcttacgtaatcactacatatctgtcggtgcctctggagctttgtttggtctacttggctgtatgctctctgagcttattatgaactggaccatttattccaacaaggcagcagccatcacaactcttctgttcataattgcaatcaatctggcgatcgggatactaccgcatgctgataattttgcgcatattggtgggttcgtatccgggttccttttcgggtttgtgctgctggcaaggcctcaatttggttggatggaacggcatgagctgccccagaccgatcaacccccaaagtacaagacgtaccagtatgttctgtggggcgcggcactgctcttgctgctggttgggtatgtggtcggcatggcgatgctcttcaagggaaagaacggcaacgacggctgccactggtgccggtacctcaactgcgtgccctcgtccaggtggaagtgcagcacttagacatggttcggttccccccgttcggcgtttctccgaaatgcatcaactcccggagaaccatttttatgcttgtgtgtttatacagataccaacatcagaggcttgtgcctcgcagagctgaatccctcctttatcttgcgtgacgatgtaattttacttcgtgcctgttggcctcggcatgattctgcgccgaccgtacctccagatttttgtcatggtat

SEQ ID NO: 399 - DNA, 1434 bp, Triticum aestivum
ccaccttccactactcctacactcccacacactacagctcgtaygtcgccgcttcccctcccccgcccgcggccgctgctataactacagkccacggagcgccagcgagggggccaaggccaaccctagctagctagacttcgcgcgcgttaggggccatggcgagcggcagcggcagcggcgaggggaaggcgggccgcgccggcgcggggtaccagcagtacgcctcgtacggcaccggcaccggctacgacgagcgccagtggtggccgtggctcgtgcccaccgtgctcggcgcctgcgtctcggtcttcgccgtcgagatgtacctcaacgactgcccccgccacgggatgtacctcggtggcgacgcgtcctgcgtcgccggattcctccgccagttctccttccagccgctgcgcgagaacccgctcctcggcccctcttcggccactttagagaagatgggagctcttgactgggccaaagttgttcatcaacaccaatggtggcgcctattcagctgtatctggctccatgctggcctaattcacttgattgtcaacatgatgagcttgctattcataggaattcgccttgaacagcaatttggctttgtccgcattgggatcatctacctgctatctggctttggtggaagtgttctgtctgcactgttcttacgtaatcactacatctctgtcggtgcctctggagctttgtttggcctgcttggctctatgctctctgagcttattatgaactggaccatttattccaacaaggcagcagccatcacaactcttctgttcataattgcaatcaatctggcaatcgggatactaccgcatgccgataattttgcgcatattggtgggttcgtatccgggttcctttttgggtttgtgctgctggcaaggcctcaatttggttggatggagcggcatgagttgccccagaccgatcaacccccaaagtacaagacgtaccagtatgctctgtggggcgcggcgctgctcttgctgctggttgggtatgtggtcggcctggcgatgctcttcaagggaaagaacggcaacgacggctgccactggtgccggtacctgaactgcgtgccctcgtccaggtggaagtgcagcacttagaagacatggttcggttccccccgttcggcgtttctccgaaatacatcccctctccggagaaccatttttatgcttgtgtgtttacaaataccaacgtcagaggcttgtgcctaggagagctgaatccctcctgtatcttgattgacgatgtaatttgagtttgtacctattggcctcagcatgattctgcaccgaccatacctctagattttgccatggtatgctgacctcgcaggcaattcatcaagggaaaggacacgtcacacgtgtgatgtgtctgcagtcatcc

SEQ ID NO: 400 - DNA, 1266 bp, Triticum aestivum
ccagcctcctccttcatttcccatccttccaccctcggcttgcgcatcacatcacgtcaccggagccagctacgggcgcgtgagactagcagcatggaggggggcggcgaggggaagggccgggcggcgccggcggcggcggcggcggggggagggttcggcgggtacgagtcggccggggaccgcaagtggtggccctggctcgtgcccaccgtcatcgtcgcctgtgtcgccgtcttcgtcgtcgagatgtgggtcaacgactgccccaggcacggcagcgcgctcggcggcggctgcgtcgcgggattcctccgacgcttctccttccagccgctccgcgagaacccgctcctcgggccctcctccaccactttggggaaaatgggagctcttgactggaacaaagtcgtccatcagcaccaggggtggcgtctcattagctgcatctggctccatgctggtctgatccatttggttgtgaacatgctaagcctgctgttcattggaattcgtcttgagcagcaatttgggtttgttcgcattggcgctatctacctactgtctggtttcggtggcagcgtgatgtctgcacttttcctccgaaataactacatctctgttggtgcatccggagctttatttgggctgcttggatctatgctttctgagctacttatgaactggactatttactccaacaaggttgcagccataataactcttctcttcataatcgcgatcaacgtggcaatcgggatactaccgcatgctgataactttgctcatattggtggattcttgaccgggttccttttggggtttgttctgctggcaaggccgcaattcggttggttggaacgcagcgagctgccccacactaatcagcctcctaagtacaaaccataccaatatgtcctgtgggttgtggcactcgtcttgctgctcgtcgggttcacgctttcgttggtaatgctcttcaagggcaagaacgggaacgacggctgccactggtgccactacctgaactgcgtgccgacgtcgaggtggaagtgcgatacctaggcggtcccttctttcggttttcgacgaaaacatgtagtgttgggaggaccatttttcatgcttgtatgtttgtagataggaactgtggtctgttaattaagtttgttcgttagtgaattctgtaaatttgtttgccaggccctgtaagtttgttactcgagcactccagtgatttcatgcgtgtttttgtgtaagaggccg

SEQ ID NO: 401 - DNA, 1266 bp, Triticum aestivum
actccagctccttccttccctccccatccttccgtcctcggcttgcacatcacatcgcgtcaccggagccagctacgagcgcgtgagaccagcagcgggacagcatggaggggggcggcgaggggaagggccgggcggcgccggcgacggcggcggggggagggttcggagggtacgagtcggccggggaccgcaagtggtggccctggctcgtgcccaccgtcatcgtcgcctgcgtcgccgtcttcgtcgtcgagatgtgggtcaacgactgccccaggcacggcagcgcgctcggcggcggctgcgtcgcgggattcctccggcgattctccttccagccgctccgcgagaacccgctcctcgggccctcctccaccactttggggaaaatgggagctctggactggaacaaggttgtccatcagcaccaggggtggcgtctcattagctgcatctggctccatgctggcctgatccatttggttgtgaacatgctaagtctgctgtttattgggattcgtcttgagcagcaatttgggtttgttcgcattggcgctatctacctactgtctggtttcggtggcagcgtgatgtctgcactcttcctacgaaataactacatctctgttggtgcatctggagctttatttgggctgcttggatctatgctttctgagctacttatgaactggactatttactccaacaaggttgcagccataataacccttctgtttataatcgcgatcaacgtggcaatcgggatactaccgcatgctgataactttgctcacattggtggattcctgaccgggttccttttggggttcgttctgctggcaaggccacaattcggttggttggaacgcagcgagctgccccataccaatcagccccccaagtacaaaccataccaatatgtcctgtgggttgtggcactcgtcttgctgcttgtcgggttcacgctttcgttggtgatgctcttcaagggcaagaacgggaatgacggctgccactggtgccactacctgaactgtgtgccgacgtcgaggtggaagtgcgatacctaggcggttccttctttcggttttcgacgaaaacccgtagtgttgtgaggaccattttcatgcttgtatgtttgtagataggaacttgttctttagtgaactctgtaaatttgtttggcaggctctgtaagtttgtaactcgagcactctccagtgattccatgcgtgtttttgtgtaaraggccgtatcgttttg

SEQ ID NO: 402 - DNA, 1834 bp, Oryza sativa
tccctccaagtccaagtgaccaaccatcatcaatcatcgctaagcccacctcggagatctcgagttcgatcgtcgtcgtcgtagctgtagaggtagttaattatctcgttttagatgagctcactgacggcggcgcagttccggtcgctgtttgagatggcaggaggggaggatatctcgtttctgtttggtgatgatgaggcggcggcggtggcggcgccggtggagttgcaggggaagagggggtgggaggaggtggatcaaggggaggggtctggggcggtggcggcgaagaggcagcggtcgccgacgagctcgagggagaatagtagcgggagtaatgagggtgggcaggaggaggtgtctgaggcggcggcggccatggcggcggcggtggggaggggtggggggaggaggctgtgggtgaaggagagggactcggagtggtgggacatggtgagtagcccggattacccggactcggagttcaggaaggcgttccgcatgtccaaggccacgttcgaggtggtctgcgacgagctcgccgccgccgtcgccaaggaggacaccatgctccgcgccgccatcccggtgcgcaagcgcgtcgccgtctgcgtctggcgcctcgccacgggggagcccctgaggctggtgtccaagcgcttcggcctcgggatctccacctgccacaagctcgtgctcgaggtctgcgccgcgctcaaggccatggtgatgcccaaggtggtgcgctggcccgaggccggcgacgcggcggccatcgccgcgcacttcgaggccatctccgggatctccggcgtcgtcggcgcgatctacaccacccacatccccatcatcgcgcccaagtccaacgtcgcctcctactacaaccgccgccacacggagcgcaaccagaagacctcctactccatgaccgtccagtgcgtcgtcgactccaccggcgccttcaccgacgtctgcatcggctggccggggtccaactccgacgaggaggtgctcgagaagtcggcgctgtacctgcaccgcggcgttcccggcctgatccagggccagtgggtggtcggcggcgggagcttcccgctcatggactggatgctcgtgccctacacccaccagaacctgacgtgggcgcagcacatgctcaacgagaaggtcgccgccgtgcgcggcgtggcgcgcgacgcgttcgagcgcctcaagcgccggtggggctgcctccagaagcgcaccgaggtgaagctgctcgacctccccaccgtgctcggcgcctgctgcgtcctccacaacatctgcgagcgcagcggcgacgccgtcgtcgacgccgacgactgcgccttcgacctcttcgacgacgacatggtcgccgagaacgccgtccgctcctccgccgccgcgcaggcccgcgacgccatcgcccacaacctcctccacagcggcggcggcgcatccttcttctgatcaagcatcatcgccgttcttggtccgatcaacagcgataccaaacaaaccaacaaaaataaaaaagaaaaacaagattcagtttttaggtgtataggaggagcttctccattttttgtcggaaatggagcagtgaacagtttttcgctttatcgtcaggagggacaggaaagttcagagtcctagtagtctcaaagtaacattagtttcttggttggattttcgattgatttggttcttttagatcttgagagattgtttttcatggggttgtaattaattgcctgcataatcttgtatcccccagattatcaattaatcaaacctgaaaaagaaaatcatttttttgccaaccaaa

SEQ ID NO: 403 - DNA, 501 bp, Persea americana
ctctctctctctctcgcatctgcagcaggcggccatggagaacgcaagaactgtgaaagacgtgtcgcctcaccagttcgtgaaagcctactccgcccatctcaaacgatctggaaagatggagcttccgcattgraccgatattgtcaagactggaaattttaaggagcttgctccttatgatccagattggtactacattagagctgcttccatggctagaaagatatacttgaggcagggtattggagtcggtgctttccagaagatctatggtgggcgcaagagaaacggaagtcggcccccacatttctgcaagagcagtggttctgttgctcgccatatccttcaacaactccagaagatgaacattattgacattgatccaaagggtgggagaagaattacatccagtggtcaaagagatctcgatcaagttgctggtcggattrytgttgctcywtswccwtswsywwggtttrattgstgsygtwrtgtgtt

SEQ ID NO: 404 - DNA, 757 bp, Musa acuminata
ggaaaaccctagtttgcgcggatcgccgtctcggtcttgggcgctcaaagcagcgacggaggagactgcaaccacaaacatggagaacgccgtggccaagaccgtgaaagacgtctcgccccacgagttcgtcaaggcctactccgcccacctcaagagatccggcaagatggagcttcctgagtggacagacattgtgaagactggaaggttcaaggaacttgctccttatgatcctgattggtactacatcagggctgcttcaatggcaagaaagatatacttgaggcagggcattggagtaggtggctttcagaagatatatggaggtcgtaagaggaatggaagtcgcccaccacatttctgcaagagcagtggggcaattgctcgccacattttgcagcagttggagaggatgaatatcattgaaattgaacctaaaggtgggaggaagattacatctcaggggcagcgggatctcgatcaagttgctggtcgtgtctagatgctgactttgatcatgctttggtttaaatctcgtcagttataaacaatattgctcagagctttagcatcaaagttgtattaattacaagttaacttgtttggtgattttgacatgatttatttcttgtattagatgattttcctgtttgagataaatgtagggtttactttaaaaracttkgttycatcmatgktgsyttgaacgttatgctgcactgcttctgtttgcaacaaaaacactagaaaagat

SEQ ID NO: 405 - DNA, 745 bp, Musa acuminata
gacctcactcggatcgccgtctcttttctcgcgtgcgcactaagcagcagcggcggttttgatggcaaccgtggagaatgccgtggccaagaccgtgaaggacgtctcgccccacgatttcgtcaaggcgtactctgcccatctcaagagatccggcaagatggagcttcctgagtggacagacattgtgaagactggaaggttcaaggaacttgctccttatgaccctgattggtactacatcagagctgcttcaatggcaaggaaaatatacttgaggcagggaattggagtaggtggctttcagaagatttatggaggccgcaagaggaatggaagtcgcccaccacatttctgtaagagcagtggggcaattgctcgccacattttgcaacagttggaaacaatgaacatcatcgaaatcaacccaaaaggaggaaggaaaatcacttctcaaggacagcgggatcttgatcaagtcgctgggcgggtatcggtgcttccctgatcgtgttctaattccattgcatcaattcagggacattttgttcagatcctcagcagcagagttactttggtgaaaagttggatgtattattttgagcatgctacatgatttgttttcttatattagccaccaatcttacaatctaagataaatgtagtttcacttcaatggtgtcggtttgcctcatccgaatgttgcttagaaacccttttgctgcaactaatataaggtttgagt

SEQ ID NO: 406 - DNA, 626 bp, Musa acuminata
agaacgacgtggccaagaccgttaaggacgtctcgccccacgagttcgtcaaggcctactccgcccacctcaagcgatccggcaagatggaacttcctgagtggacagacattgtgaagactggaaggttcaaggaacttgctccttatgatcctgattggtactacattagagctgcttcgatggcaagaaagatatatttgaggcagggtattggagtaggtggctttcagaagatttatggaggccgcaagaggaatggaagtcgtccaccacatttctgtaagagcagtggagccattgctcgccacattttgcagcagttgcagaggatgaatatcatcgaaatcgaacctaaaggcggaaggaggattacttctcaagggcagcgggatcttgaycaagttgctggacgtgtctgagtgcaacctcgatcttttggttctatgacatcagtttggaaagattttgctcagagctttagtagcggagttgttttaatcaaaagttggacatgtttgggcatttgacatgatttatttcttctgttggacaatctttctgcttgagataaatgtagggtttactttgaacagattatttcagtggaatgttccttacaagtc

SEQ ID NO: 407 - DNA, 506 bp, Hordeum vulgare
cgcacacctatcccttcttcttgaagacaacgccgactgcggcaagagcgcaggatggcgaccgtccccgctcccgcagacgagaccgctggctccacggcgcgcacggtcaaggatgtgaacccccacgagttcgtcaaggtctactccgcgcacctcaagcgctcctgcaagatggagcttaccgagtgggttgacattgtcaagactgcaaggttcaaggagctgccgcctactgacgctgactggtactacatcagggctgcctccatggcaaggaagatctacctgaggcagggaattgggattggtggattccagaagatctatggtggccgtcagaggaactgttcacgccccccacacttatgcaagagcagtggtgctgtttcccgcaacatccttcatgagttgcagaagatgggcatcattgatgtcgaccccaagggtggaaggctcatcacctcccagggaaggcgtgatcttgaccaagttgctggaactgg

SEQ ID NO: 408 - DNA, 856 bp, Hordeum vulgare
cggcacgagggaaaaccctagtccctcgcagccgcagcggcgcgcacacctctccctccttcgtgaagacaacgccgccggcggcaagagcacaggatggcgaccgtccccgctcccgcagccgagaccgcggcctccacggcgcgcacggtcaaggatgtgaacccccacgagttcgtcaaggcctactccgcgcacctcaagcgctccggcaagatggagcttcccgagtgggttgacattgtcaagactgcaaggttcaaggagctgccgcctactgacgctgactggtactacatcagggctgcctcgatggcaaggaagatctacctgaggcagggaattgggattggtggattccagaagatctatggtggccgtcagaggaacggttcacgccccccacacttctgcaagagcagtggtgctgtttcccgcaacatccttcaggagttgcagaagatgggcatcattgatgtcgaccccaagggtggaaggctcatcacctcccagggaaggcgtgatcttgaccaggttgctggaactgttcctgctgaattctgatcagttgaagtcccatctatgaaattgtgttccgtagtaggatttggctacagttttgaattatgataccctccctgtgtttgttatgcaagacttcgttgaagtagatcgcatgctattatggtacaatggttaattgtctgagtttttaattatctgcccgcctgggagaatctttatgcttttgcgagttcttgtgataaagttcgatttctgtccagtgtgaaattggtgctggtgattggctatcttaacatttcggatcggcatctttagaacacttatatctaag

SEQ ID NO: 409 - DNA, 678 bp, Hordeum vulgare
ctttcagccgcagcggcgcgcacacctctcccttcttcgtgaggacaacgccgccggcggccagagcacaagatggcgaccgtccccgctcccgcacccgataccgcggcctccacggcgcgcacggtcaatgatgtgaacccccactagttcgtcaaggcctactccgcgcacctcaagcgctccggcaagatggagcttcccgagtgggttgacattgtcaagactgcaaggttcaaggagctgccgcctactgacgctgactggtactacatcaaggctgcctcaatggcaaggaagatctacctgatgcatggaattgggattggtggattccagaagatctatggtggccgtcagaggaacggttcacgccccccacacttctggaagagcagtggtgctgattgccgctacatccttcaggagttgcagaagatgggcatcattgatgttgacgccaatggtggaaggctcatcacctcccgaggaaggcgtgatcttgaccacgttgctggaactgttcctgctgaattctgatcaagtgaagtcccatctatgaaattgtgttccgtagtctgattaggctacaggcttgaataatgataccctccctgtgttggttatgcgagacttcgttgaagtagatcgcatgctattgtggtacaatggttaatg

SEQ ID NO: 410 - DNA, 810 bp, Brachypodium distachyon
aaaccctagcccccggcagccgcagcggcgcgcaccccacctcctccttgacagcggtgtcgtcggcgacaggcggcaggatggctacccctactgagaccgcagccgcggcctcctcggcgctcacggtgaaggatgtcgccccccacgacttcaacaagaaatacgccgcgcacctcaagcgctcgggcaagatggagcttcctgagtgggttgatattgtcaagactgcaaggttcaaggagcttcctcccaatgatcccgattggtattacatcagagctgcttcaattgcaaggaagatctacctgaggcagggtattgggatcggtggcttccagaagatctacggtggacgacagaggaatggctcacgtcccccgcacttctgcaagagcagtggtgctatttcccgcaacatcctgcaggagttgcagaagatggggatcattgacgttgatcccaagggtggaaggatcatcacctcccagggaaggcgtgatcttgaccaggttgctggaacagttgctcctgaaatctgatcaatggaaactatcttaatgtttggtagtagaatttggctacagttttgaatccagatacccatgtgtttgttcctgaaagatgttaacgtgggatgtgtccaattatgttgggatgagatattttcggagcttctaggttaaccgccagaccatctatgtttgtgaacccttgtattggagtctcttggcgtatgcaagtcttttattttgtgggtatattatgcaattctttggtcatgaatgtggattggttgcattttttcaa

SEQ ID NO: 411 - DNA, 447 bp, Brachypodium distachyon
gccgcggcctcctcggcgctcacggtgaaggatgtcgccccccacgacttcaacaagaaatacgccgcgcacctcaagcgctcgggcaagatggagcttcccgagtgggttgatattgtcaagactgcaaggttcaaggagcttcctcccaatgatcccgattggtattacatcagagcggcttcaattgcaaggaagatctacctgaggcagggtattgggatcggtggcttccagaagatctacggtggacgacagaggaatggttcacgccccccgcacttctgcaagagcagtggtgctatttcccgcaacatcctgcaggagttgcagaagatggggatcattgacgttgatcccaagggtggaaggatcatcacctcccaaggaaggcgtgatcttgaccaggttgctggaacaattgctcctgaagtctgatcaattgaa

SEQ ID NO: 412 - DNA, 499 bp, Brachypodium distachyon
gccacggcctcctcggcgctcacggtgaaggatgtcgccccccacgacttcaacaagaaatacaccgcgcacctcaagcgctcgggcaagatggagcttcctgagtgggttgatattgtgaagactgcaaggttcaaggagcttcctcccaatgatcctgattgctactacatcagagctgcttcaattggaaggaagatctacctgaggcagggtattgggatcggtggcttccagaagatctacggtggacgacagaggaacggttcacgccccccgcacttctgcaagagcagtggtgctatttcccgcaacatcctgcatgagttgcagaagatggggatcattgacgttgatcccaagggtggaaggatcatcacctcccagggaaggcgtgatcttgaccaggttgctggaacagttgctcctgaagtctgatcaattgaaactatcttcatgtttagtagaatttggctacagttttgaatccagataccca

SEQ ID NO: 413 - DNA, 653 bp, Cenchrus ciliaris
tctccctctcgtcccccagcggtggcggcgcggcaggatggcggcttcgacggcgaggacggtgaaggatgtcaacccgccctacttcgaaaaggcctactccgcccacctcaagcgctcgggcaagatggagcttcctgagtgggttgacattgtgaagactgcgaggttcaaggagctccctccttatgacccygmctggtwytacaccagggctgcctcgattgcgaggaagatctammwgargcaaggcatcggtgtgggtggcttccagaagatctatggtggtcgccagaggaatggctcccgtccaccacacttytgcaagagcagtggtgccatttcacgcaacatcctkywkywattgcasamsatgggcatcatcgatgttgatcccaagggtggasggstgattacttcccagggaaggcgtgatctggaccaagtggctggaagggttgctgttgaagcttgagcagtctcataaaatggttgagatggctgctttgagttaggacttgtgstgccctatttttgttcagagaatttgaagtgtaatgcatctagacatctagctwtggagcagcactatatcctcgctgaatatctaatgcaatatcagaacatccagaaccaaagaaatttgtttgtga

SEQ ID NO: 414 - DNA, 784 bp, Cichorium intybus
cattggcggggggcaacactaaacacagacaaaccctcgccaaagatcttggccgccgttgcaacgaaagcagcctgaaacatggagacggcgactgcgagaacggtgaaagacgtttcacctcatgagtttgtcaaggcgtacgccgctcacctcaagcgctccggcaagatggagcttccacactggactgatatcgtcaagactgctacattcaaggagcttgcaccttatgatcccgattggtactacattagagctgcatccatggcaaggaaaatttacttgaggggagggattggtgttggtgctttccagagaatctatggtggacgcaagaggaatggtagtgccccacctcacttctgcaagagcagtggtggtattgctcgccatattcttcagcagttgcagaccatgaacattgttgactttgatgcaaagggtgggaggaagattacttctaatggaagaagagatcttgaccaagttgcaggaagagtagttgttgttaccccttgaaagagcttgtaatggacacatcaaaatacaaggtttcaattttatccatcttgggacagatttagttttactggtaaatctattttctgctatgcccacaagacataatttcatgtgttatttttgtcggttagttttaaagattgtctttacattttgacattcccctttcaccctgaattcactttcatgtattaagattatggttttgtttcatggttagtaccaagttaccaagcagttatatttgaattacaaaaaa

SEQ ID NO: 415 - DNA, 670 bp, Cichorium intybus
gcattggcgggggctgccaatttctctcgtcagctcaaagcgccccaacgcagctacaatggcgacggcgagaactgtgaaggatgtttctcctcatgaattcgtacagggttacgcagctcatctcaaacgatctggcaagatggagcttcctgaatggactgatatagtaaaaaccgctaccttcaaggaacttgctccttacgatccagattggtattatatcagagcagcttcaattgctaggaaaatatacttgaggggtggtattggagtcggtgcgtttcagaggatctatggtgggcgtaaaagaaacggaagtgcaccaccacatttctgcaaaagcagtggtggaattgttcgtcacattcttcaacaattggaaaccatgaaaatcattgatatggatcccaaaggaggaagaaggattacatctaatggtcgacgagaccttgaccaagttgcgggacgaattgtggttgcaccttgaagaatttgaataatttttgaagttatgtagcttaattatgaatttagctaaaacaaaaaaacaaattttggcggaagagtattgttttttattttaagttgtttgtgtttgggtgatatttttgagaatttgtggattggagttggacttgattttaaggaaaaaaaatatgtttgaaaa

SEQ ID NO: 416 - DNA, 781 bp, Citrus sinensis
ggggagagagagagagcgcaattccaccaccttcttgcaaaagcgaagctttgagtcgctctcctgctctgttgtgaccatggctaccgctaggactgtcaaggacgtgtctcctcatgagttcgtgaaggcttactctgctcatctcaagcgatctggcaagatggaacttcccccatggactgacatagtcaagactgctcagttcaaggagcttgctccctatgaccctgactggtactatgtcagagctgcctccatggcaaggaaaatctacttgaggcaagggcttggtgtgggttctttcaggaggatttatggtggaagtaagaggaatggaagtcgtccacctcacttctgcaaaagcagtggtgctattgctcgccacattcttcaacagttgcagaacatgaacattatagatattgagcccaagggtggaaggagaattacttccagtggccaacgagaccttgaccaagttgccggaaggattgtcgttgctccttgaagctgctcgacggtgatcttgtttgatttattgcaggtttttgttagttgatggaatgatgttgcattcttaagtaagttttgattccaagtgtggactttttatgatgaacccagcttcagttttgttgcttttagatgtttgacatttatctgtagtattcactataaattcctgctatccaagaggctgttgttttatagatattatatttctgatctgttgttgatttcattaatcaattcacaaggatgggaaggatattgatag

SEQ ID NO: 417 - DNA, 632 bp, Trifolium pratense
cgccgccggcagcatcaaccatggcaactgcaaggacagtgaaggatgtttccccacacgagtttgtcaaagcttactccgctcatctcaagcgatctggaaagatggagcttcctgaatggaccgatattgtgaagactgcaaagtttaaggagttggctccttatgatcctgactggtactatatcagagctgcttccatggcaaggaagatttacatgaggggaggacttggtgttggtgctttccagaggatttatggtggaagccagaggaacggtagtcgtccacctcatttctgcaagagcagcggtgctattgctcgtcacattcttcaacaattgcagaacttgaatatcattgagatggacaccaagggtggcaggaaaatcacttccaatgggaggagggatttggaccaagttgccggaaggattgttgttgctccttgatctgttatctgcttctaggttttgaattctgtctttgagagattttataacagataatgtgaaattttgattttagttatgagtgtttatgtattagactcatttaatcctatgtttctttttagacattcaaatggtactgtcacattttattttattcactggattttttggattttc

SEQ ID NO: 418 - DNA, 867 bp, Vigna unguiculata
agatagagaacgcggcataacctaaggccatctttgttttctgtgtctgtgcatcaaccacaaccagaagccgccatggccactgcaaggactgtgaaggacgtttctccccacgagttcgtcaaggcgtactcttctcaccttaagcgatctggcaagatggagctgccagagtggactgatattgtcaagacagcaagatttaaggagttggctccctatgatcctgactggtactatgttagagctgcttccatggctagaaagatctacttgagaggaggacttggtgttggtgcatttcagaggatttatggcgggagcaagaggaacggtagccgtcctcctcatttctgcaagagcagtggtgccattgcccgtcacattcttcaacagttgcaaaccatgaacatcattgaactggacaccaagggtggcaggagaatcacttccagtggccggcgggatcttgatcaagttgccggacgcattgtggttgcaccttgatctgtaaactgccaatgagagctagtctgctgccataagcactattaagattttggggttttgttagagagatgtgatgataacagattatgcgcaaattttgattttagactgagtgtctttctatttattggacgtgcttaatgtttatgatgttcttgctttcagtcttttattagatcatattgccacattttttttcttttgatttttcattttggatattcctttttttgtttttttacttatgaaatgaagattaagggtagattaaactgattacgggaagtggctataattcttcttgattcatctattgtgtaactgagcatttgccaatatgatattttaatttgggta

SEQ ID NO: 419 - DNA, 614 bp, Taraxacum officinale
gcgggggcgcagctacatggcgacggcgagaactgtgaaggatgtttcccctcatgaattcgttaagggttacgccgctcacctcaaacgatctggaaagatggagcttcctgaatggactgatattgtgaagactgctacttttaaggaacttgccccctatgaccctgactggtattatatccgagctgcttctattgctaggaaaatttatctgaggggyggtattggtgttggtgcgttccagagaatctatggtgggcgtaagaggaayggtagtgctccaccrcatttctgcaaaagcagcggtggyatcattcgtcatatccttcaacaactggaaacaatgaaaatcattgatatggatcccaagggtgggagaagaatcacttcaagtggtcggcgggacctygatcaagttgctgggcgaattgttgttgctgtttgattccrgtcatattttttatgttatgtascttatacatttagcatgaasgaacaaattttggttgttttttgtttggtgcrtttgtggatttggcyttctgttttgaatcagtacttgtatgagttaattcactrtattcrtgtttgagttaattgagaagttggct

SEQ ID NO: 420 - DNA, 762 bp, Festuca arundinacea
ggcacgaggctagccttcgcagccgcagcggcgcgcacccatcttcctccttcctgaagacagcggcctcgtcggcgagaggacaggatggcgaccgaggcaccagctgagaccgcggcctccacggcgcgcacggtgaaggatgtcaacccccacgccttcgtcaaggcctactccgcycacctcaagcgctccggcaagatggagcttccggagtgggtygacattgtcaagactgcaaggttcaaggagctcccgccctatgatgctgactggtactacatcagggctgcctcgatggcaaggaagatctacctgaggcagggtattgggattggtggcttccagaagatttatggtggacgccaaaggaatgggtcacgacccccacacttctgcaagagcagtggtgctgtttctcgcaacatcctccaggagttacagaagatgggcatcgtggatgtcgaccccaagggtggaaggctcatcacctcccagggaaggcgcgatcttgaccaggttgctggaaccgttcctgctgaattctaagcagttgraatccccttgatggaatcatgtttggtagtagaatttggctacagttttgagccctgcgtttgttatgaaagaatttgaactagcatgcatccagtttatggtacaatgagatattgtctgagcttctaaattaactgccagttcttcatgggtaatcttttgcttttgaactcttgtgatgaagttggattttctccttatctc

SEQ ID NO: 421 - DNA, 726 bp, Zingiber officinale
gtccgccgcttccaccacctgcatcgcgctcgaagcagagaagaagagaagggagcgccatggagatcagcgcgtcaaagaccgtgaaggacgtctctccccacgaattcgtcaaggcgtactcatcccatttgaagagatcgggcaagatggaacttcccgaatggacagacatcgtgaagactggaaggttcaaggaactggctccttatgaccctgattggtactatatcagagctgcctcaatggcacggaagatatatctgagccagggaattggagttggtggttttcagaaaatctatggggggcgcaagaggaacggaagccgtccaccgcatttctgtaagagcagcggggcgattgctcgtcacattttgcaacaattggagacgatgaatatcattgaaatcaaccctaaaggtggaaggaagattagttctcaagggcagagggaccttgatcaagtagctggacgtgtctgacgactttcaaatatctttaggcccatttttatcagcatggagatgtgagttagacttgttttggccaattgtcttttaatttcgaacttcactaaacaatgaacgtaaaaaattggcagataatggatatcttatgccatgctaggactgatatatttgcttgccaatgtatctgtttcccgtttttcttgattatcctcggtaagaattaatcaggctaatagagtttgatggctggtcg

SEQ ID NO: 422 - DNA, 771 bp, Ipomoea nil
tgagttgtgtcgttccatcctggtcagcggcgccctctcaacgcttctccctgcagaggtgccagcaattgcagcaatggcgacggcgagaactgtgaaagacgtttctcctcacgagttcgtgaaggcttactctgctcaccttaagcgttctggaaagatggaacttcccgagtggactgatattgtgaagactggtaggttgaaagaacttgctccatatgaccctgattggtattacatcagagcagcttccatggctaggaagatttacttgaggggtggccttggagttggagccttccaaaggatctatggatcaaacaagagaaatggaagctgcccacgccacttttgcaagagcagtggtgctattgcccgccacattttgcaacaattgcagacaatgagtatcattgaagttgatccaagaggtggaaggaggataacatccagtggccaacgcgatcttgatcaagttgctggccgaattgttgttgttgcaccttgaaggacagtagtgattgcacggcagaagcaagatatatgtgatgtttgaactactgttataattagcttgttccagagatgttacttccaaaattttgagacaattcttactttcaaatacttgggtagcttccttgtgtttcatccaaaatgtttgtgttgttgaagtttgaatattaatcttatcaggttctgagaattgacattgttatatcatttatgccttttacagattgattccatccatttccaaaaaaaaaa

SEQ ID NO: 423 - DNA, 758 bp, Ipomoea nil
gcattaggccgggggaagcacttgagttgtgtcgttctatcttggtcagcggcgctctctcaacgcttctccctgcagaggtgccggcaattgcagcaatggcgacagcaagaactgtgaaagacgtttctcctcacgagttcgtgaaggcttactctgctcaccttaagcgttctggaaagatggaactcccggagtggactgatattgtgaagactggtaggttgaaagaacttgctccatatgaccctgattggtattacatcagagctgcctccatggctaggaagatttacttgaggggtggccttggagttggtgccttccaaaggatttatggatcaaacaagagaaatggaagctgcccacgccacttctgcaagagcagtggtgctattgcccgccacattttgcaacaattgcagacaatgagtatcatcgaagttgatccaagaggtggaaggaggataacatccagcggccaacgcgatcttgatcaagttgctggccgaattgttgttgttgcaccttgaaggacagtagtgattgcactgcagaagaaaagatatatgtgatgtttgaactactgttataattagtttgttccagagatgttacttccaaaattttgagacaattcttactttcaaatacttgggtagcttccttgtgtttcatccaaattgtttgtgttaagtttgaatattaatcttatcaagttctgagaattgactttgttatatcatttatgcctttta

SEQ ID NO: 424 - DNA, 657 bp, Lactuca sativa
gctccattgccgtcgtctcttttgctgtaatcgaagatcaatagctgcatctacaatggcgactgcaagaaccgtgaaggatgtttctcctcacgaattcgtcaaggcttattccgctcatctgaaaagatccggcaagatggagcttcctgaatggactgatattgtcaagactgctactttcaaggaacttgctccctatgatccagattggtactatatcagagctgcttctattgctaggaaaatatacctgaggggtggtcttggtgttggtgcattccagaggatctacggtggtcgtaaaaggaatggaagtgctccaccacatttctgcaaaagcagyggtggcattgctcgtcacattcttcagcagttggaaaccatgaaaatcattgatatggacccaaaaggagggaggaggataacttctaatggmagacgggatcttgaccaagttgctggaskwattgttcttgcaccttgaaaactttgaagtggctgagatwatatgtagttaagtttatcmttgtattcgawttgagtcctttttgtttttgttstaattttgatcgataytgaagatggtagacatrtttcttttacatycaaaagtttagagagattttgaattggagtatatgaattgaggtattt

SEQ ID NO: 425 - DNA, 573 bp, Lactuca sativa
gccattgctcttcgtgcaggtctaaatcgcctcaacgcagctacaatggcgacagcgagaactgtgaaggatgtttccccgcatgaattcgttaagggttacgccgctcatctcaaacgatccggcaagatggagcttcctgaatggactgatatcgtgaagactgcgaccttcaaggaacttgctccttatgatccagattggtattacatcagagctgcttcaattgctaggaaaatatacttgagaggtggtcttggtgttggtgcactacagaggatctatggcggacgtaagagaaatggaagcgctccaccacatttctgcaaaagcagtggtggaattgctcgccatatccttcaacaattggaaaccatgaaaatcatcgatatggatcccaagggaggaagaaggatcacatctaatggtcgacgagaccttgatcaagttgcagggcggattgtggttgttgcaccttgaagaattcaaataatttttgatgttatgtagctctattatgaatcttaactttaaaaaaatttaaatcaaattttgtttgaagaaatcttgttt

SEQ ID NO: 426 - DNA, 651 bp, Lactuca sativa
gctctcgtgcggtctaatcgcctcaacgcagctacatggcgacagcgagaactgtgaaggatgtttccccgcatgaattcgttaagggttacgccgctcatctcaaacgatccggcaagatggagcttcctgaatggactgatatcgtgaagactgcgaccttcaaggaacttgcaccctatgatccagattggtattacatcagagctgcttcaattgctaggaaaatatacttgagaggtggtcttggtgttggagcgttgcagaggatctatggtggacgtaagagaaatggaagcgctccaccacatttctgcaaaagcagtggtggaattgctcgccatatccttcaacaattggaaaccatgaaaatcatcgatatggatcccaagggaggaagaaggatcacatctaatggccgaagagaccttgatcaagttgcagggcggattgtggttgttgcaccttgaagaattcaaatcatttttgatgttatgtagctttattatgaatcttaacttaaaaaaatttaaatcaaattttgtttgaagaaatcttgttttcaattttgagctgtttgtgttttggtggtatttttgagaatttgtggatttggaacatgagtacatgtaatcaatcacttaactactt

SEQ ID NO: 427 - DNA, 719 bp, Lactuca sativa
gccattgctcttcgtgcaggtctaaatcgcctcaacgcagctacaatggcgacagcgagaactgtgaaggatgtttccccgcatgaattcgttaagggttacgccgctcatctcaaacgatccggcaagatggagcttccagaatggactgatatcgtgaagactgcgactttcaaggaacttgctccctatgatccagattggtattacatcagagctgcttcaattgccaggaaaatatacttgagaggtggtcttggtgttggagcattacagaggatctatggcggacgtaagagaaatggaagcgctccaccacatttctgcaaaagcagtggtggaattgctcgccatatccttcaacaattggaaaccatgaaaatcatcgatatggatcccaagggaggaagaaggatcacatctaatggtcgacgagaccttgatcaagttgcagggcggattgtggttgttgcaccttgaagaattcaaatcatttttgatgttatgtagctttattatgaatcttaactttaaaaaaatttaaatcaaattttgtttgaagaaatcttgttttcatttttgagttgtttgtgttttggtggtatttctgagaatttgtggatttggaacatgagtacatgtaatcaatcacttaactacttaagctctaatcctgatacttgaattaatacactccaatgaggaatgattgtgtagga

SEQ ID NO: 428 - DNA, 784 bp, Glycyrrhiza uralensis
gccttggccgttgtgtgttgtgtgtgttcgtgtgagagggagaggcacaaccagaagcagaagcaaaaatggcgacttcgagaacagtgaaggatgtttccccacacgagttcgtgaaggcttatgcttctcacctcaagagatctggcaagatggagcttcctgaatggacagatattgtgaagactgctagatttaaggagttggctccttatgatcctgattggtactatattagagctgcttccatggcaagaaagatctacttgaggggaggacttggtgttggtgcatttcagaggatttatggtgggagccaaaggaatggtagtcgcccacctcatttctgcaagagcagcggtgctattgcccgtcacattcttcaacagttgcagaacatgagcatcattgaactcgacaccaagggtggcaggagaatcacttccagtggccgacgggatctggaccaagtggctggacggatcgtggttgctccttgatctgtaaactgcttctaggttttgggttcttgttggagatgtgatgaaaacagattatgtgcaattttgattttagttatgagtgtcttatcctttggacgtgatcaatgttatgtttctttttagtcttttagatgatcttgtcacattttattttttcagttgagtttttttggattttcaccctaaacattcttgtcctttcagtgtcctttgtctgaaatgaacattttaagggtaaatttaaattacactaattaatgacaactaaactactgaattga

SEQ ID NO: 429 - DNA, 854 bp, Glycyrrhiza uralensis
gcctaagggtttctgttctgtgccgtgtgtgagtgtgtgagagagagagagcgagagagccacaaccagaagcagaagcaaacatggctaccgcgagaactgtgaaggacgtttctccacatgagtttgtgaaggcttacgcttctcacctcaagagatctggaaagatggaacttcctgaatggacagatattgtgaagactgcaagatttaaggagttggctccttatgatcctgattggtactttgttagatctgcttccatggcaagaaagatctacttgaggggaggacttggtgttggtgcatttcagaggatttatggtgggagcaagaggaacggtagtcgcccacctcatttctgcaagagcagcggtgctattgcccgtcacattcttcaacagttgcaggacatgaacatcattgaactggacaccaagggtggcaggagaatcacttccagtggccggcgggatctggaccaagtggcgggacggatcgtggttgcaccttgatctggaaaccgctttctaggttttggttttgtgccggagagatgtgatgaaaacagataatcttcaatgttatgttgctttttagtctctcaagattagatgatcttgtcacattttttttttctgagttttttggattacattcttgtcctttcagtgtcctttacgtttgaagtgaaaattttaagggtaaattacactggccgcttattgtgtgtgttatgctataacgacactgaactacaaaattgatcccgtgttacacaatctatatctgggactagcatatgcatagtcacatgcatattcaactagaattagaatgagcctttatttagc

SEQ ID NO: 430 - DNA, 678 bp, Liriodendron tulipifera
gttgtttctctcttctctccttcctttgtgctcttcttcctctcttctgaggcagtggcaatggaggcagcaagaacggttaaagacgtgtctcctcacgatttcgtgaaagcttattccgctcatctcaagcgatctggaaagatggaactgccacattggactgatatcgtgaagactgctagattcaaagaacttgctccatatgaccctgattggtactatattagagctgcttccatggcaagaaaaatctatttgaggcaaggaattggagttggtgggtttcagaagatttatggcgggcgcaagagaaacgggagtcgcccacctcatttctgtaagagcagtggttctattgctcgtcacatcctccaacagcttcaacagatgagcattattgacattgatccaaaaggtgggaggagaatcacttccagtggtcagcgggatctcgatcaagttgctggtcggattgttgtcactccttgagcagtgagttttcagcatgcatttatattttggagcttctgtagggtgttctcaaacgactttgtaggttcttgattcaatggtttcttagtcttttgtgagggttaatgatatagaggcatgttttgttttgtgaacatcagagtacattaagatgacttgatatacatggtttgaattgggtta

SEQ ID NO: 431 - DNA, 757 bp, Lotus japonicus
cacgagggcattttcactcttcagcggcgacagtgcgaaaccatcacccaccatcgccattaccatcaaccatggcttctgccaagactgtgaaggacgtttcgcctcacgagttcgtcaaggcttactctgctcatctcaaacgatctggcaagatggagctgccagaatggacagatattgtgaaaaccgcaagatttaaagaattggctccctatgatcctgattggtattatgttagagctgcttccatggcaaggaagatctacttgagagggggtcttggtgttggtgcatttcagaggatttatggtgggagccagaggaatggaagccgccctcctcatttttgcaagagcagcggtgccattgctcgtaacattctccagcagttgcaggagatgaacatcattgagatggacaccaaaggtggcaggagaattacatccagtggccggcgggatcttgaccaagtggctggaaggattgtagttgcaccctgatgctgaacactgctgctagtcaacacaaattgtaggttaaatatgtttgttggagagaaatgggatgccagattatttcaaaattttggttttagacacctgagcaccttctaagttggatatttatgttcctattaatctcttagatgatattttcctgcatttaatgaaagatttccmatcttcatcttgggcattctgttcattgagtgaatgaaagcctgaaggataagttaacttgtcttttgtttttc

SEQ ID NO: 432 - DNA, 718 bp, Lotus japonicus
cctttcggtgtgcgagagcgagagagagtgagagagagagaggcacagccagaagctgaagcagaagcagccatgtctactgcaaggactgtcaaggacgtttctccacatgagttcgtcaaggcctacgctgctcatctcaagcgatctggcaagatggagcttccagagtggaccgatatcgtgaagactgctaggtttaaagagttggctccttatgatcctgactggtactatattagagctgcttccatggcaagaaagatctatttgagaggtggacttggtgttggtgcattccagaggatttatggtgggagccagaggaatggtagccgccctccccatttctgcaagagcagtggttctattgctcgtcacattcttcaacagttgcagaccatgcacatcattgaacttgacaacaagggtgggaggaaaatcacttccagcggccgtcgagatctggaccaagtggctggacggattgtggttgttgctccttgatcggtaacttctacccggctgcttctatgaccacaacagattttgttttgatattagttaccgagtgtcttatgtattggccgtaccgaatgttatgttgcttttagatgatcttgtcacatttaattttactagttttttgaattttcgtctggtacattattgttcttcaagtggccttgcgtatgaaatggaattttatgtttgaact

SEQ ID NO: 433 - DNA, 1407 bp, Eragrostis curvula
  misc_feature (88)..(88): n is a, c, g, or t
ctttcccccctggaaagcgggcggcggcggagaggaaggaccgacgacggcagaatggcggcctccaccccttaaaagggtcaaggangtcaacccccacgacatcgrcacggcctactccgcccacctcaagcgctccggcaagawggagctccctgagtgggtagacattgtcaagactgctaggttcaaggagctcccrccttatgaccctgactggtactrcattcgtgctgcctcgattgcgaggaagatctacctgaggcagggcattggtgtgggtggcttccagaagatctacggtgggcgccagaggaayggctcacgccccccrcatttctgcaagagcagtggtgccatttctcgcaacatcctgcagcagctkcagaagatgggcatcattgatgttgatcccaagggtggaaggctcatcacctcccagggaaggcgtgatcttgaccaggttgctggaagggttgccattgtcgaatgagcagtttcagtttagatcatctcaatgtgatcatgtttggtagcagaatttctctacagttttgaatcaggatatgcctttgttggytgaatgaacccgatgtaggattcrtccagttatgcttctgtgcmatattttctgaagtaaatyaactgtcagttattatgtttatgaacccctgtgatgaaatcatggttctggaagtatgcaatcgtcacttttctggtttcgtaaaataaaaaaacaaaaaaaaaaactaacaactccaaataaagacaaaaaacataaaaaaaaaaagtcccccgcgtctgaatcactggcttaaatccaaagagattcccggccgcctgcaggtcaacatatgggaaaactcccacgccgttgaaagaaaacctggaattattctatagagttccccaaaaaagttggacgaaaaccaggccaaactgttttccgggggaatttgtttcccctcccaaattccacaaactacacaagcggaaaccttaaggcgtaaacccgggggggcccaaagaaaggagatacctccaattaatggctttcgcccccacgcccacttttccagcgggaaaccggtgcgtgtcaccctgcttttttgaaaccggcgctcacgccggggagaaagggggggttgcggtttgggggccccttcccccctttccccccccccctgagacccccctgcccctcgctccggtctggggggcgggggcgagggagtttcccctccccactccaagcggggcaaaaatccgccttcttccccaacagagactccgggtgtgcataaaaatccatgaaaaaaaacaacatctagatagtacaaaagggaggcccctccaacaataagagggcgctgcgctgacacacgccctgttaaaaaacaacatagc

SEQ ID NO: 434 - DNA, 832 bp, Zea mays
acgccgaaccgtcatatataaatttatactcgctgccacgccgctcctccaaaccctagtctcagagcagccgcatccacaacctgcctctctcgtcccctggcggcgtccgcggcaggatggcggaatctacggcgaggacggtgaaggatgtcaacccgcacgagttcgtcaaggcctactccgcccacctcaagcgctccggcaagatggagctccctgagtgggttgacattgtgaagactgcgaggttcaaggagcttcctccttatgatcctgactggtactacatcagggctgcatccattgcaaggaagatctacctaaggcaaggcatcggtgtgggtggctttcagaagatctacggtggccgccagaggaatggctcccgcccaccacacttctgcaagagcagtggtgctgttgcacgcaacatcctgcagcagctgcagattatgggcatcatcgatgtcgatcccaagggtggacgcctcatcaccaaccagggaaggcgtgatctggaccaagtggctggaagggtcgctgttgaagcgtgagcagtgtcatctttggtttcaatggtgtcatgtttgatggttgagaaggctgcgctctatttgctcttttgggttaggattttcgagttcagaggactttaaggtttattgcatctagctatggcgccacactatgttccccgagtacctaatgtgatatcaagactcaattctcgaatctaagatatatgtttgcaaagtgtctgaccaggtatcaataatgtgtctttcttttggtacagatatacgtgataataacgtgcagttattggcca

SEQ ID NO: 435 - DNA, 727 bp, Zea mays
caggccgcatccacaacctgcctctctcgtcccctggcggcgtccgcggcaggatggcggaatctacggcgaggacggtgaaggatgtcaacccgcacgagttcgtcaaggcctactccgcccacctcaagcgctccggcaagatggagctccctgagtgggttgacattgtgaagactgcgaggttcaaggagcttcctccttatgatcctgactggtactacatcagggctgcatccattgcaaggaagatctacctaaggcaaggcatcggtgtgggtggctttcagaagatctacggtggccgccagaggaatggctcccgcccaccacacttctgcaagagcagtggtgctgttgcacgcaacatcctgcagcagctgcagattatgggcatcatcgatgtcgatcccaagggtggacgcctcatcaccaaccagggaaggcgtgatctggaccaagtggctggaagggtcgctgttgaagcgtgagcagtgtcatctttggtttcaatggtgtcatgtttgatggttgagaaggctgcgctctatttgctcttttgggttaggattttcgagttcagaggactttaaggtttattgcatctagctatggcgccacactatgttccccgagtacctaatgtgatatcaagactcaattctcgaatctaagatatatgtttgcaaaaaaaagtgcaatttcgtttatgatttgtggacctgtc

SEQ ID NO: 436 - DNA, 764 bp, Cucumis melo
aaaaccctagagtttgagaaaggcggaaaccctacttcagcaatcggagcttttcccggcctttgctcacttaattcaacagccatggccactgctaggaccgtcaaggacgtctctcctcacgagtttgttaaggcctatgccgctcatctcaagcgatccggaaaggttgaacttccaccatgggcggatattgtcaaaactgcaagattcaaggagcttgctccatatgatgcagattggtactacgtgagagctgcatccatggcaaggaagatctacttgagaggaggtcttggtgttggagcattcaagcggatttacggtggaagcaagaggaacggaagtcgccctccacacttctgtgaaagcagtggagccatcgcccgccacattctacaacaattgcaggagatgaacattgttgatgtggacccaaagggtggaaggagaattacttcaagtggtcgacgagacctcgatcaagttgctggccggattgttgttgccccatgattaatcaattacctctattgttaaattagagacttatgttttgctgatgagaaacaattttcttatgcgtcattaaaattttggatttagctgttgaaagattttccagatgaagatgcttactcttgttttttcacggtctaaagttcatttactctcccttttgttttataatttctttttctggawtttttttggaagaaacatgttttcacttttttatccacatcaactttgatgcttggcac

SEQ ID NO: 437 - DNA, 566 bp, Pennisetum glaucum
  misc_feature (552)..(552): n is a, c, g, or t
gcacgaggcccacaccccgtctccctctcgtcccgcagcggcggcgcggcggcaggatggatggcggcttcgacggcgaggacggtgaaggatgtcaacccgcacgagttcgtcaaggcctactccgcccacctcaagcgctcgggcaagatggagcttcctgagtgggtcgacattgtgaagactgcgaggttcaaggagcttccaccttatgacgctgactggtactacaccagggctgcctcgattgcaagaaagatctacctgaggcaaggcatcggcgtgggtggtttccagaagatatacggtggccggcagaggaatggctcccgtccaccacacttttgcaagagcagtggtgccatctcgcgcaacatcctgcagcaactgcagaagatgggcatcattgatgttgatcccaaggggggacgactgattacttcccagggaaggcgtgatctggaccaagttgctggaagggttgctgtgaactttgagcaagtctcatcttctgttcgattattatgttctggtatgggtggttgagtttanggactttttgtgct

SEQ ID NO: 438 - DNA, 579 bp, Nuphar advena
gaggaagaaggggccgaagcagcagcagcagcagcaggcatggcggccgcaaggacggtgaaggacgtctctccccacgacttcgtcagttcttactcctctcatctcaaacgctccggcaagatggagctgcctcattggacagacattgtcaagactgctacattcaaggagcttgctccatatgatcctgattggtattatgtaagagctgcatcgatagcaagaaaaatctacctgaggcagggaattggtgttggtggattccaaaagatttatggtggaaggaagaggaatggatcccgccctccacatttctgcaagagcagtggctccatcgctcgtcacatcctgcagcagttggagaagatgaacataattgagatgaatcccaaggggggaaggcgcattacatctagtgggcagcgtgatcttgatcaggttgctggccggattgcagtgacagcataagaccttgttccgtttctagccagaggaagatccacaacacactctatatatatgtgaracttgagaggcacccctcttattgcttttgagkttatccttcagctgcat

SEQ ID NO: 439 - DNA, 691 bp, Avena sativa
ggcgcgccgccacttcttccttcctggagacagcggcctcgtcggcgagaggacaagatggcggccgctcctccggccgaaaccgcggcctccacggcgcgcacggtgaaggatgtgaacccccacgagttcgtcaaggcctactccgcccacctcaagcgctccggcaagatggaacttccggagtgggttgacattgtcaagactgcaaggtttaaggagctcccaccctatgatgctgactggtactacatcagggctgcctcgatggcaaggaagatctacctgaggcagggaattgggattggtggcttccagaagatctatggtggacgccaaaggaatgggtcacgacccccacatttctgcaagagcagtggtgctgtttcccgcaacatcctccaggagttgcagaagatgggcattgtggatgtcgaccccaagggtggaaggctcatcacctcccagggaaggcgtgatcttgaccaagttgctggaaccgtccctgctgagttctgagcagttggaatcccctttgatggaatcatgttcggtagtagaactggctacagttttgaactatgtttgttatgaaagaatttgagttagcatgcatccagtttgtggtacaatgtgatattgtcgatcttctaaattaactgccagttgttctgggataatcttatgcttt

SEQ ID NO: 440 - DNA, 725 bp, Elaeis guineensis
tccgtccctttctttgcctcttgaccgccgccgagagcagctccccgcagcggtgacgatggaagcggctgcaaggacggtgaaggacgtctcggcccacgagttcgttaaggcgtacgccgcccatctcaagcgttccggaaagatggagcttcctcactggacagatattgtgaagactggaagatttaaggagcttgctccatacgaccctgattggtactacatcagagctgcttctatggcaaggaagatatatctgagacagggtattggagttggtggtttccaaaagatttatggagggcgcaagaggaatggaagccgtccaccacatttctgcaaaagcagtggggcaatagcgaggcacattctgcaacagttgcaggagatggacattattgattttgatcctaaggggggaaggatgattacctcccagggacggcgtgatcttgatcaggttgctggaagggttgttgttgctccttgagcgagtgttaggtgcttaaactgtgcttctgtcttttgaagaacttgttacctgccggttttatacagattttgatgtctggacttttttgcctaatcgggttcagttgtgttagctgctggctgtctgaaatttagaatgaaatttcccatgagttcagtggttgaagtacttgtgatctgtctattgttttattaacggagcctaaagaaaatgacgccttgtttgctcc

SEQ ID NO: 441 - DNA, 677 bp, Elaeis guineensis
taaaccctatagcgctcccatcctcttctttctgtgcctctggaccgtcgccgagagcagcccaccacagccgcgacgatggagacggccaggacggtgaaggacgtctcggcccacgagttcgtcaaagcgtacgccgcccatctcaagcgatccggaaagatggagcttcctcactggacagatattgtgaagactggaagatttaaggagcttgctccatatgaccctgattggtactacatcagagctgcttctatggcaaggaagatatatctgagacatggtattggagttggtggtttccaaaagatttatggagggcgcaagaggaatggaagccgccccccacatttctgcaaaagcagtggggcaatagctaggcacattctgcaacagttgcaggagatggacattattgattttgatgctaaagggggaaggatgattacctcccagggacggcgtgatctggatcaagttgctggaagggttgtagttgctccttgaaccagtgttaggtgcttaaattgtgcttatctcttttgaagaacttgttacctgtcagttttatagcattttttatgtccggattttgcctaatcgagttcagttgtgttgcttggctgctgactctctaaaatctagaatgaaatttcccatgagctgaatagttg

SEQ ID NO: 442 - DNA, 637 bp, Elaeis guineensis
ctagcttggatcatggaggcggcttctagaaccgtgaaggacgtctcgcctcacgatttcgtgaaggcgtatgccgcccacctcaagcgatccggaaagatggaacttccgcactggacagatattgttaagactgggaggttcaaggagcttgctccttatgaccctgattggtactacatcagagctgcttccatggcaagaaagatctatctgagacagggtattggtgttggtggtttccagaagatttatggagggcgcaagagaaatggatcccgtccaccacatttttgcaagagcagtggtgcaatagctcgccacatcttgcagcagttgcagaatatgaacattattgacattgatccaagaggtgggaggaaaataacttcccaggggcaacgtgacctagatcaagtagcgggccggattgtccttgtaccttgatgagttgctgcagttctggtccctgtcatcaatgaagagattttggttatggtctttggcatttttggttttaggatttctccattcactttataattgtcaacttttatattagtattggaaactcttatgggcaggttgtgttattctctataatccttttcattgtttgctagtaaactcattttta

SEQ ID NO: 443 - DNA, 649 bp, Allium cepa
ctcgcccggctctacgtacgcaagcactcaaatcgaaggcaaattatggcggaagaagcggctgtcggaaggacagttaaggacgtttgtccgcatgagtttgtgaaagcatactctgctcatcttaagcgatctgggaagatggagcttccccaatggactgacattgtgaagacaggaaagttcaaggaacttgctccctatgatcctgattggtattacattagagcagcttccatggcaaggaagatctatttgaggcaaggaattggggttggtggctttcaaaagatctatggtggcagtcagagcaatggaagtcgtccatcacatttctgcaagagcagtggtgctgtcgctcgcagcattcttcaccagttagaagccatggatatcgttgagaaagatgccaagggaggaaggaaaataacatctcaaggacgtcgtgatcttgatcaagtagctggacgagttcaagccgtacctgcttaagttttcagtttttgagcagttgtttccttaaattgtctaaacttaatttgatgtagtttggaccttatattattttagcgctgctgaaacaatgtttgttttgaacttgcttctctctttgtattttgtgaatctacaacttcgttgaatgtttttc

SEQ ID NO: 444 - DNA, 786 bp, Carica papaya
actcttctccgtcactcgttagagctgccgccgcagaagcagaagcacgagtagaggcagagcgccttgaaaatcagaagagtatggagactgcgagaacagtgaaggacgtgtccccccacgagttcgtcaaggcatacgccgcccacctcaaacggtccggcaagatcgaacttcctccatggactgatattgtcaagaccgggaaattcaaggagcttgctccttacgatcccgactggtactttgtaagagctgcttccgtggcaaggaaaatatacttgagggggggccttggtgttggtgccttccagagaatctatggaggaagccagaggaatggcagtagacctcctcatttctgtaagagcagcggtgctattgctcgtcacatacttcaacaattgcaaaatatgaacatcatcgatgttgatcccaagggtgggaggagaattacgtccagtggccagcgagaccttgaccaagttgctgggaggattgcagttgcccgttgagagatttggcttcaccatcaattgaaagattttagaaattttgaatcaatcatgagtcaagagtagatagaataggcattgtgtcagttcatattcaggttgttacgttcgatacttaacgaacatgattttatttcttaaagcagttgttgtctccttgggtttctttgatcttggatttagttttagttggtgaaaatccatttcaattatattattgtctgttttgtcttcttcatatatatatatatacatattgcctttttgtctt

SEQ ID NO: 445 - DNA, 756 bp, Ananas comosus
caaaaccccccctcctcctcgtcctcgatcgatcgagctcgttagggtttcgagccatggaagcggcgaggacggtgaaggacgtctccccccacgagttcgtgaaggcgtactccgcccacctcaagcgatccggaaagatggaacttcctgagtggacggatattgtgaagaccggaaggttcaaggagcttgctccctacgaccccgactggtactacatcagagctgcttctatggctaggaagatctatctaaggcaaggtattggcgtcggtggcttccaaaagatttatggtggccggaagaggaatggctgccgcccgcctcacttctgcaaaagcagtggtgcagtagctcgccacatcctgcaacagttgcagagcatgagcattatcgacgtcgatcctaaaggtgggaggatgataacttctcagggaaggcgcgatctcgatcaggtggcaggaaggattacggtcgtaccttgagttgagttcttgaaagcaaaaaaaaaaaaatgtcggttyttaacttttgttactgttggatttacggcacttyttttttcatatatctgtagcggttatggtgatgagccctattttagaacattgtcgatggttttgtaaaccctactttgcattgaattttgtcctaggacyaaaacccgcattgcgtcttaaggttcctttagatttttaaatttgcaagtgagttcccttttgcgtgccaataatctgatgatttgaacatgtt

SEQ ID NO: 446 - DNA, 798 bp, Ananas comosus
acagaagatccttcttatttcggcgcggtgctgcgaaaccctaatcttaaccctaaccctagcccgtgatcgggatctccctcttcgctgcggccatggagacggcgaagaccgtgaaggacgtctcgcctcacgagttcgtgaaggcgtactccgctcacctcaagcgatccggaaagatggaacttcccgaatggactgatattgtgaagaccgggaggttcaaggagctcgctccttacgatcctgattggtactacattagagctgcttcaatggcaagaaagatatatctaagacaaggtattggtgttggtggtttccagaagatttacggggggcgcaagaggaacggttgccgcccgccacatttctgcaaaagcagtggcgcggttgctcgccacatcctgcaacagttgcagaaaatgaacattatcgacgttgaccccaagggtgggagagcgataacttctcagggacggcgtgatttggatcaggtggctggacggatcgtcgttgttccctgagcaagcttctgaggttctgaaacttctgatcctagccatgtttgatgaatattattggccgcatagctcgttgcagttttggagttagtcatttgtttggagttaagcaaaatagatatatcttagaaccttctcgaagttactgtagtctctctttttccctattgctcgcatgtttgtgtttggattttgctggtttcttatggaagattttttggaaccctatcttatcaatctgttgagatataaaaacatgattattgttcgtctc

SEQ ID NO: 447 - DNA, 660 bp, Papaver somniferum
cagatttcgaggcagagctcaaaactctttgaagaaggtccgtcattgtaaaccctaactaagcagagctacaatggagaccaccgccaaaactgtcaaggatgtttcccctcatgagtttgttaagcattactcagctcatctcaagcgatctggaaagatggagcttcctcactggacagacattgtgaagaccgcaaagttcaaggagcttgctccttacgatgctgactggtactacatcagagcagcttccatggctaggaagatctacttgaggcaaggacttggtgttggttgtttcaagaaaatctacggtgggcgcaagaggaacggaagtcgaccaccacatttctgcaagagcagcggttcaattgcccgccatattttgcaacaactgcaggacatgaaaatcgtcgaccttgaccccaagggaggaaggattattacatccagtggtcgtagggatctcgatcaagttgcaggacgtattgtagttgctgctccttgaacaaattaattggacagcgaaattacagtcgtactatgaagggttttgtggtctcagtttgttttcttttttgctggaacaaaatagatgttgagagtatgttaaacaccyttttcccatatatccatyagtactcggaattggagata

SEQ ID NO: 448 - DNA, 742 bp, Oryza sativa
caaaaacctagcccctcaagcagccgcaccctcactctcctctcctgccccccacggcggcggcgggatggcggattcgacggcgaggacggtgaaggacgtgaaccctcatgagttcgtcaaggcctactccgcccacctcaagcgctccggcaagatggagctccctgagtgggttgacatcgtgaagactgcgaggttcaaggagctccctccttatgatccggactggtactacacgagggctgcctcgattgcaaggaagatctacctgaggcagggtattggtgtaggtggcttccagaagatctatggtggccgccagaggaacggctcacgccccccgcacttctgcaagagcagcggcgctatctcacgcaacatccttcagcagctgcagaagatgggcatcattgatgtcgacccgaagggtggaagactcatcacctcccagggaaggcgtgatctggaccaagtggccggaagagttgatgttaccatcgcctgaacagatccattgatcctcaacccttaatgcctgtcatgtttggtggttgagttggctacagtttgtttgcagttttgaattagaacatgccctatctttgttggctcagagaattggaagttggatgcatctagttatgatattgcagtatgtgttttttgtcttttgctgaatgaactcctaatgcactgtcactagttccggacaaaagaaaattaaattatgccaatggaa

SEQ ID NO: 449 - DNA, 673 bp, Secale cereale
gccgcagcggcgcgcacacctctccctccctcctgaagacagcgccgccgtcggccagagcacaggatggcgacmgtccccgctcccgcagccgagaccgcggcctccaccgcgcgcacggtgaaggacgtcaacccccacgagttcgtcaaggcctactccgcgcacctcaagcgctccggcaagatggagctyccygagtgggttgacattgtcaagactgcaaggttcaaggaacttccgcctactgatgctgactggtactacatcagggctgcctcgatggcaaggaagatctacctcaggcagggaattgggatcggcggcttccagaagatctacggtggccgtcagaggaacggttcacgcccaccgcacttctgcaagagcagtggtgctgtttcccgcaacatcctccaggagttgcagaagatgggcatcattgatgttgaccccaagggtggaaggctcatcacctcccagggaaggcgcgatctggaccaggttgccggaactgttcctgctgaattctgatcagtcgaagtcccctctatgcaatcgtgttcggtagtagaatttggctacagttttgaattatgataccctccctgtgtttgttatgcaagacttcgaagtagatcgcatgctattatagtacaatgaatatagtctg

SEQ ID NO: 450 - DNA, 818 bp, Sorghum bicolor
agagcagccgcatccacactacctgcctctctctctctcgtcccctggcggcggcggcggcggcgacaggatggcggcttccacggcgaggacggtgaaggatgtcaacccccacgagttcgtcaaggcctactccgcccacctcaagcgctccggcaagatggagctacctgagtgggttgacattgtgaagactgcgaggttcaaggagctccctccttatgaccctgactggtactacaccagggctgcatctattgcaaggaagatctacctgaggcaaggcattggtgtgggtggcttccagaagatttatggtggccgccagaggaatggctcccgtccaccacacttctgcaagagcagtggtgccctctcacgcaacatcctgcaacagctgcagaagatgggcatcattgatgtcgatcccaagggtggaaggctcatcacatcccagggaaggcgtgatctggaccaagtggctggaagggttgctgttgaagcttgagcagtctcatcttcggtttctatgatgtcatgtttgatggttgagatggctacactttatttgcatttttggattaggactttttagttcagagagctttaaggtttaatgcatctagctatggctccacactatattttacctgagtacctaatgtgatctcatcttcggtttgcaaagtgcctgagcctgtatccatgacctatcttccttttgctacagatctatatgataatataagtgtctgagctggtatccacttttcctgtccaatttgtttaacgaaaagcaaaatagacttgggtatggt

SEQ ID NO: 451 - DNA, 783 bp, Sorghum bicolor
cctagccccagagcagccgacactacctgcccctctctcgtccggcggcgttcggcaggatggcggcgtctacggcgaggacggtgaaggatgtcaacccccatgagttcgtcaaggcctactctgcccacctcaagcgctccggcaaggtaacgctgcacgactcgctcactttcccatctgattcgaggctacatcggctgtttcgcactgcggcaatggagctcccagagtgggttgacatcgtgaagactgcgaggttcaaggagctccctccgtatgaccctgactggtactacaccagggctgcatccattgcgaggaagatctacctgaggcaaggcattggtgttggtggcttccagaagatttacggtggccgccagaggaatggctcccgcccaccgcacttctgcaagagcagtggtgccatttcacgcaacatcctgcagcagctgcagaagatgggcatcattgatgtcgatcccaagggtggacggctcatcacggctcagggaaggcgtgatctggatcaagtggctggaagggttgctgttgaagcttgaggagtcatcttcagtttcaatgatgtcatgttgagatggctagactttaatcgcacctttgtcatgttttgatggttgagatggctaaacattattttgcacttttggattaggatttgagttcagagaactttaagatttgatgcatctagctatgtgatatcaaaactcattttggaaccaaatataaatatgcatgtcgtgtcttccttttggt

SEQ ID NO: 452 - DNA, 870 bp, Glycine max
gctgtgagtgagacaccgatagatagagagcgcggcataacctaaacctatctttcttctctctctgtgtgtgcgcatcaacggcaaccagaagcagccatggccactgcaaggactgtgaaggatgtttcacctcatgagttcgttaaggcgtactcctctcacctcaagcgatccggcaagatggagctgccagagtggactgatattgtgaaaactgcaagatttaaggagttggctccttatgatcctgactggtactatgtcagagctgcttccatggcaagaaagatctacttgagaggaggacttggtgttggtgcctttcagaggatttatggtgggagcaagaggaatggtagtcgccctcctcatttttgcaagagcagtggtgccattgctcgtcacattcttcaacagttgcagaacatgaacatcattgaactggacaccaagggtggcaggaaaatcacttccagtggccgacgggatcttgaccaagtggctggacgcattgtggttgcaccatgattcatgatttgaaaatgccataagcatattgaggtttttgggttcttgttagagagatgtgataacagattatgctcaaattttgattttagactgagtgtcttttgtgtattagacatgctcaatgtttatgttgctttcagtcattttagataatattgctacatttaatttgagtttttctttggacattcttgttccttaagtgtcttttacgtatgaaatgaaatttaagggtaaattaaactgattacatggtgtatgttttgatgacacaccaaactaccaagttatgccaatttgtgctctctatgtcatattatgttttccaattattcc

SEQ ID NO: 453 - DNA, 782 bp, Glycine max
ggtgctgtgagtgagattacccatagatagagagcgcggcataacctaaacttacccttcttctctctgtgtgtgtgcgcatcaaacgcaaccagaagcagccatggccactgcaagaactgtgaaggacgtttctcctcatgagttcgtcaaagcttactcttctcacctcaagcgatctggcaagatggagctgccagagtggactgatattgtgaaaactgcaagatttaaggagttggctccttatgatcctgactggtactatgtcagagctgcttccatggcaagaaagatctacttgagaggaggacttggtgttggtgcctttcagaggatttatggtgggagcaagaggaatggtagccgccctcctcatttctgcaagagcagtggtgctgttgctcgtcacattcttcaacagttgcagaacatgagcatcattgaactggacaccaagggtggcaggaaaatcacttccagtggccggcgggatcttgatcaagtggctggacgcattgtggttgcaccttgatttgaaaacgccataagcatattgaggtttttggtttctggttagagagatgtgatgataacagattatgctaaagttttgattttagactgtcttttatgtatcggacatgctcaatgtttatgttgctcccagtcctttttagatagtattgctatatttaattgagtttttttccccggacattgttgttgcctaagtgtcatttacgtatgaaatgaaaattaagggtaaattaaactgatta

SEQ ID NO: 454 - DNA, 891 bp, Saccharum officinarum
  misc_feature (842)..(842): n is a, c, g, or t
ccccagagcagccgcatccacactacctgcctttctctcgtcccctggcggcggcggcggcaggatggcggcatctacggcgaggacggtgaaggatgtcaacccccacgagttcgtcaaggcctactccgcccacctcaagcgctccggcaagatggagctccctgagtgggttgacattgtgaagactgcgaggttcaaggagctccctccatatgaccctgactggtactacaccagggctgcatccattgcaaggaagatctatctgaggcaaggcattggtgttggtggcttccagaagatttacggtggccgccagaggaatggctcccgcccaccacacttctgcaagagtagtggtgccatttcacgcaacatcctgcagcagctacagaagatgggcatcattgatgtcgatcccaagggcggacggctcatcaccgcccagggaaggcgtgatctggaccaagtggccggaagggttgctgttgaagcttgagcagtctcatcttcggtttcaatgatgtcatgtttgagatggctgcactttttttgcacttttggattagggttttttagttcggagaactttaaggtttaatgcatctagctatggcgccacactatattttccctgagtacctaatgtgatatcaaagactcattctggaaccaaagatatatgtttgcaaagtgtctgagcaatccatgacctatcttccttttggtacaaatctatgtgataatacattgcaaagtgtctgagctggtatccacttttcctgtccaatctctttaacgaaaagcaaaataggggtgggtatggttactgtcattgncttgtggatatttttgggtgcaatgagtgtttcacatgcagtcactctg

SEQ ID NO: 455 - DNA, 708 bp, Saccharum officinarum
ccagagcagccgcatccacatccacactacctgcctctctctcgttccgtggcggcggcggcggcaggatggcggcatctacggcgaggacggtgaaggatgtcaacccccacgagttcgtcaaggcctactccgcccacctcaagcgctccggcaagatggagctccctgagtgggttgacattgtgaagactgcgaggttcaaggagctccctccttatgaccctgactggtactacaccagggctgcatccattgcaaggaagatctacctgaggcaagggattggtgtcggtggcttccagaagatttacggtggccgccagaggaatggctcccgcccaccacacttctgcaagagcagtggtgccatttcacgcaacatcctgcagcagctgcagaagatgggcatcattgatatcgatcccaagggtggaaggctcatcacatcgcagggaaggcgtgatctggaccaagtggctggaagggttgctgttgaagcttgagcagtctcatcttcggtttctatgatgtcatgtttgatggttgagatggctacactttatttgcactttggattagggtttttgagttaagagaactttaaggttcaatgcatctagctatggcgccccactatattttccctgagtacctaatgcagtatttaaactcattctggaaccaaagaaatatgtttgcgaattg

SEQ ID NO: 456 - DNA, 796 bp, Saccharum officinarum
cagccgcatccacactacctgcctttctctcgtcccctggcggcggcggcggcggcaggatggcggcatctacggcgaggacggtgaaggatgtcaacccccacgagttcgtcaaggcctactccgcccacctcaagcgctccggcaagatggagctccctgagtgggttgacattgtgaagactgcgaggttcaaggagctccctccatatgaccctgactggtactacaccagggctgcatccattgcaaggaagatctatctgaggcaaggcattggtgttggtggcttccagaagatttacggtggccgccagaggaatggctcccgcccaccacacttctgcaagagtagtggtgccatttcacgcaacatcctgcagcagctacagaagatgggcatcattgatgttgatcccaagggcggacggctcatcacctcccagggaaggcgtgatctggaccaagtggccggaagggttgctgttgaagcttgagcagtctcatcatcggtttcaatgatgtcatgtttgatggttgagatggctgcactttatttgcacttttggattaggattttttagttcagagaactttaaggtttaatgcatctagctatggcgccacactatattttccctgagtacctaatgtgatatcaaagactcattctgtaaccaaagaaatatgtttgcaaagtgtctgagctggtatccatggcctatcttccttttggtacaaatctatgtgataatacattgcgaagtgtctgagctggtatccactttttctgtcc

SEQ ID NO: 457 - DNA, 744 bp, Saccharum officinarum
ctcgcagccgcatccacactacctgcctttctctcgtcccctggcggcggcggcggcggcggcggcggcaggatggcggcatctacggagaggacggtgaatgatgtcaacccccacgagttcgtcaaggcctactccgcccacctcaagcgctccggcaagatggaactccctgagtgggttgacattgcgaagactgcgaggttcaaggagctccctccatatgaccctgactggtactacaccagggctgcatccattgcaaggaagatctatctgaggcaaggcattggtgttggtggcttccagaagatttacggtggcccgcaaaggaatggcttccgcccaccacacttcttgcagagtattggtgccatttcacgcaacattctgcagcagctacaaaagatgggcatcattgatgttgaatccaaaggggggacgggttataaccttccagggaaaggctggatctggaaccaattgggcccgaagggctggctgttgaagcaaagcgcagttctattaatcgggtttcaatgattggcatgttttgattgggtgaaaacggctttgacttttcatttgccctttgaggattaacgatttttttagatcgaacaaactttaaaggatttaaagcattcttcgccttcgtggcgcaagctataattttcccttgagatcactgaatgggataccaaaaactcacttcttgtgacccacaaaataattgtgttgtcc

SEQ ID NO: 458 - DNA, 658 bp, Saccharum officinarum
  misc_feature (524)..(524): n is a, c, g, or t
acctgcctctctctcgttccgtggcggcggcggcggctgcggcggcggcaggatggcggcatctacggcgaggacggtgaaggatgtcaacccccacgagttcgtcaaggcctactccgcccacctaaagcgctccggcaagatggagctccctgagtgggttgacattgtgaagactgcgaggttcaaggagctccctccttatgaccctgactggtactacaccagggctgcatccattgcaaggaagatctacctgaggcaagggattggtgttggtggcttccagaagatttacggtggccgccagaggaatggctcccgcccaccacacttctgcaagagcagtggtgccatttcacgcaacatcctgcagcagctgcagaagatgggcatcattgatgtcgatcccaagggtggaaggctcatcacgtcgcagggaaggcgtgatctggaccaagtggctggaagggttgctgttgaagcttgagcagtctaatcttcggtttctgtgatgtcatgtntgatggttgaaatggctacactttatttgcactttggattagggttttgagttatttgaacttaaaggtcaatgcatctaactatggcgccccactatattttccctgattaatgcagtatttaaactcattct

SEQ ID NO: 459 - DNA, 622 bp, Saccharum officinarum
  misc_feature (487)..(487): n is a, c, g, or t
  misc_feature (542)..(543): n is a, c, g, or t
cctttctctcgtcccctggcggcggcggcggcaggatggcggcatctacggcgaggacggtgaaggatgtcaacccccacgagttcgtcaaggcctactccgcccacctcaagcgctccggcaagatggagctccctgagtgggttgacattgtgaagactgcgaggttcaaggagctccctccatatgaccctgactggtactacaccagggctgcatccattgcaaggaagatctatctgaggcaaggcattggtgttggtggcttccaaaagatttacggtggccgccagaggaatggctcccgcccaccacacttctgcaagagtagtggtgccatttcacgcaacatcctgcagcagctacagaagatgggcatcattgatgtcgatcccaagggcggacggctcatcaccgcccagggaaggcgtgatctggaccaagtggccggagggttgctgttgaagcttgagcagtctcatcttcngtttcaatgatgtcatgtttgagaatgctgcactttttttgcactctttgattannggtttttaatttcgacaactttaaggttaatgcatctaactatggcgccacactatattttccctgagtacctaatgtg

SEQ ID NO: 460 - DNA, 590 bp, Saccharum officinarum
cccagcccccagagcagccgcatccacactacctgcctttctctcgtcccctggcggcggcggcggcaggatggcggcatctacggcgaggacggtgaaggatgtcaacccccacgagttcgtcaaggcctactccgcccacctcaagcgctccggcaagatggagctccctgagtgggttgacattgtgaagactgcgaggttcaaggagctccctccatatgaccctgactggtactacaccagggctgcatccattgcaaggaagatctatctgaggcaaggcattggtgtttggtgcttccagaagattacggtggccgccagaggaatggctcccgcccaccacacttctgcaagagtagtggtgccattttacgcaacattctgcagcagctaccagagatgggcattattgatgtcgatcccaagggcggacggctcatcaccgcccagggaaggctgatctggaccaagtggcccggaaggttgcttgtgaaacttgagcaatctcatcttcgggttcaatgatgtcatggttgaaattgctgcacttttttttgcacttttggattaaggtttttaattcg

SEQ ID NO: 461 - DNA, 712 bp, Saccharum officinarum
  misc_feature (688)..(688): n is a, c, g, or t
catccacatccacactacctgcctctctctcgttccgtggcggcggcggcaggatggcggcatctacggcgaggacggtgaaggatgtcaacccccacgagttcgtcaaggcctactccgcccacctcaagcgctccggcaagatggagctccctgagtgggttgacattgtgaagactgcgaggttcaaggagctccctccttatgaccctgactggtactacaccagggctgcatccattgcaaggaagatctacctgaggcaagggattggtgtcggtggcttccagaagatttacggtggccgccagaggaatggctcccgcccaccacacttctgcaagagcagtggtgccatttcacgcaacatcctgcagcagctgcagaagatgggcatcattgatatcgatcccaagggtggaaggctcatcacatcgcagggaagggcgtgatctggaccaagtggctggaagggttgctgttgaagcttgagcagtctcatctttcggtttctttgatgtcatgtttgatggttgagatggctacactttatttgcactttggattagggttttttgagttaagataactttaaaggttcaatgcatctagctatggcgccccactatatttttcctgagtacctaatgcagtatttaaacttattctggaaccaaaaaaatatgtntgcgaaagtgtctgaacttatatc

SEQ ID NO: 462 - DNA, 662 bp, Saccharum officinarum
  misc_feature (662)..(662): n is a, c, g, or t
cccagagcagccgcatccacactacctgcctttctctcgtcccctggcggcggcggcggcaggatggcggcatctacggcgaggacggtgaaggatgtcaacccccacgagttcgtcaaggcctactccgcccacctcaagcgctccggcaagatggagctccctgagtgggttgacattgtgaagactgcgaggttcaaggagctccctccatatgaccctgactggtactacaccagggctgcatccattgcaaggaagatctatctgaggcaaggcattggtgttggtggcttccagaagatttacggtggccgccagaggaatggctcccgcccaccacacttctgcaagagtagtggtgccatttcacgcaacatcctgcagcagctacagaagatgggcatcattgatgtcgatcccaagggcggacggctcatcaccgccccaggaaagcgtgatctggaccaagggcccgaagggttgctgttgaagcttgaaccatctcatcttcggttcaaatgatgtcctcgttgacatgggttgcccttctctggaccttaggcatcagggtatacgtccgcccaaacttagggttaatgcctctacctacggtgccaccccatattcccccggcatccccctcgtgatatctcacaaan

SEQ ID NO: 463 - DNA, 689 bp, Saccharum officinarum
ccgcatccacatgcacactacctgcctctctctcgttccgtggcggcggcggctggatggcggcatctacggcgaggacggcgaaggatgtcaacccccacgagttcgtcaaggcctactccgcccacctcaagcgctcctgcaagatggagctccctgagtgggttgacattgacgaacactgctaggttcaaagagctccctccttatgaccctgactggtactacaccagggctgcatccattgcaaggaagatctacctgaagcaagggattggcgtcggtggcttccagaagatttacggtggccgccagaggaatggctcccgcccaccacacttctgcaagagcagtggtgccatttcacgcaacatactgcagcagctgcagaagatgggcatcattgatgtcgatcccaagggtggaaggctcatcacatctcagggaaggcgtgatctggaccaagtggctggaagggttgctgatgaagctcgagcagtctcatctgaggattctatgatgtcatgtatgatggctgagatggctacactgtatttgcactgtggattacggtttgtgagttaagagaactttcaggttcaatgcatctagctgtggcgccccactatatgattccctgagtacctaatgcagtatttaaactcattctggaaccaaagaaatatgtt

SEQ ID NO: 464 - DNA, 751 bp, Saccharum officinarum
aactgcatctctctcgttccgtggcggcggcggcggcggcggcggcggcaggatggcggcatctacggcgaggacggtgaaggatgtcaacccccacgagttcgtcaaggcctactccgcccacctcaagcgctccggcaagatggagctccctgagtgggttgacattgtgaagactgcgaggttcaaggagctccctccttatgaccctgactggtactacaccagggctgcatccattgcaaggaagatgtacctgaggcaagggattggtgtcggtggcttccagaagatttacggtggccgccagaggaatggctcccgcccaccacacttctgcaagagcagtggtgccatttcacgcaacatcctgcagcagctgcagaagatgggcatcattgatgtcgatcccaagggtggaaggctcatcacgtcgcagggaaggcgtgatctggaccaagtggctggaagggttgctgttgaagcttgagcagtctcatcttcggttttctatgatgtcatgtttgatggttgagatggctacactttatttgcactttggattagggtttttgagttaagagaactttaaaggtcaatgcatctagcttatggccccccactatattttcccttgtgtaacctaatggcagtatttaaacttattcttggaacccaaaaaaattgttttggagacatatattctctaacaaggggcgggccgctctttaaagaatccaaggcttacctt

SEQ ID NO: 465 - DNA, 706 bp, Saccharum officinarum
tagagcagccgcatccacatccacactacctgcctctatctcgttccgtggcggcggcggcaggatggcggcatctacggcgaggacggtgaaggatgtcaacccccacgagttcgtcaaggcctactccgcccacctcaagcgctccggcaagatggagctccctgagtgggttgacattgtgaagactgcgaggttcaaggagctccctccttatgaccctgactggtactacaccagggctgcatccattgcaaggaagatctacctgaggcaagggattggtgtcggtggcttccagaagatttacggtggccgccagaggaatggctcccgcccaccacacttctgcaagagcagtggtgccatttcacgcaacatcctgcagcagctgcagaagatgggcatcattgatgtcgatcccaagggtggaaggctcatcacatcgcagggaaggcgtgatctggaccaagtggctggaagggttgctgttgaagcttgagcagtctcatcttcggtttctatgatgtcatggttgaaggtttgagatggctacactttatttgcactttggattagggtttttgaatttaagagaactttaaggtttcaaatgcatttaagctattggcgcccccacctatttttttccccttagttcccctaaaggccgtatttttaaaactcaattttgggaaactcaaga

SEQ ID NO: 466 - DNA, 719 bp, Saccharum officinarum
  misc_feature (621)..(621): n is a, c, g, or t
ctcaagcgctccggcaagatggagctccctgagtgggttgacattgtgaagactgcgaggttcaaggagctccctccatatgaccctgactggtactacaccagggctgcatccattgcaaggaagatctatctgaggcaaggcattggtgttggtggcttccagaagatttacggtggccgccagaggaatggctcccgcccaccacacttctgcaagagtagtggtgccatttcacgcaacatcctgcagcagctacagaagatgggcatcattgatgttgatcccaagggcggacggctcatcaccgcccagggaaggcgtgatctggaccaagtggccggaagggttgctgttgaagcttgagcagtctcatcttcggtttcaatgatgtcatgttagagatggctgcactttttttgcactttgggattagggttttttagttcggagaactataaggtttaatgcatctagctatggccccactctatattttccctgagtacctaatgtgatatcaaagactcatttctggaaccaaagatatatgtttgcaaagtgtctgagcaatccatgacctatctctcttttggacaaatatatgggatcatcttgggngaaagaaatcaacctccttacggtgcacgtgaccgttgtggagtaaaaaaaagaggggcgcctttagaaaacaacctatcttacccggctgcgaggat

SEQ ID NO: 467 - DNA, 567 bp, Saccharum officinarum
  misc_feature (430)..(430): n is a, c, g, or t
  misc_feature (479)..(479): n is a, c, g, or t
  misc_feature (515)..(515): n is a, c, g, or t
  misc_feature (539)..(539): n is a, c, g, or t
cacactacctgcctctctctcgttccgtggcggcggcggcaggatggcggcatctacggcgaggacggtgaaggatgtcaacccccacgagttcgtcaaggcctactccgcccacctcaagcgctccggcaagatggagctccctgagtgggttgacattgtgaagactgcgaggttcaaggagctccctccttatgaccctgactggtactacaccagggctgcatccattgcaaggaagatctacctgaggcaagggattggtgtcggtggcttccagaagatttacggtggccgccagaggaatggctcccgcccaccacacttctgcaagagcagtggtgccatttcacgcaacatcctgcagcagctgcagaagatgggcatcattgatatcgatcccaagggtggaaggctcatcacatcgcanggaaggcgtgatctggaccaagtggctggaagggttgctgttgaagctngagcagtctcatcttcggtttctatgatgtcatgtntgatggttgagatggctacacttntattgcactttggattaggtttctgaag

SEQ ID NO: 468 - DNA, 471 bp, Saccharum officinarum
ccagagcagccgcatccacatccacactacctgtctctctctcgttccgtggcggcggcggcaggatggcggcatctacggcgagcacggtgaaggatgtcaacccccacgagttcgtcaaggcctactccgcccacctcaagcgctccggcaagatggagctccctgagtgggttgacattgtgaagactgcgaggttcaaggagctccctccttatgaccctgactggtactacaccagggctgcatccattgcaaggaagatctacctgaggcaagggattggtgtcggtggcttccaaaagatttacggtggccggcagaagaatggctcccgcccaccacacttttgcaagagcagtggtgccattttacggaacattctgcaatagcttgagaaaatgggcattaatgatgtcgatcccaagggtggaaagcttatcacaatccaaggaaaggctgatcttgaac

SEQ ID NO: 469 - DNA, 623 bp, Saccharum officinarum
agcagccgcatccacatccacactacctgcctctctctcgttccgtggcggcggcggcaggatggcggcatctacggcgaggacggtgaaggatgtcaacccccacgagttcgtcaaggcctactccgcccacctcaagcgctccggcaagatggagctccctgagtgggttgacattgtgaagactgcgaggttcaaggagctccctccttatgaccctgactggtactacaccagggctgcatccattgcaaggaagatctacctgaggcaagggattggtgtcggtggcttccagaagatttacggtggccgccagaggaatggctcccgcccaccacacttctgcaagagcagtggtgccatttcacgcaacatcctgcagcagcttgagaacatgggcatcattgatatcgatcccaagggtggaaggctcatcacatcgcagggaaggcgtgatctggaccaagtggctggaagggttgctgttgaaacttgagcagtctcatcttcggttctatgatggcatgtcgaagggtgaaatggcttccctttatttgcaccttgaataaggcttttgagttaaaaaaacttcacggtcaatggctttactttagggccct

SEQ ID NO: 470 - DNA, 689 bp, Saccharum officinarum
gtcgaccccgcgtccggcagcccgcatccacactacctgcctttctctcgtcccctggcggcggcggcggcaggatggcggcatctacggcgaggacggtgaaggatgtcaacccccacgagttcgtcaaggcctactccgcccacctcaagcgctccggcaagatggagctccctgagtgggttgacattgtgaagactgcgaggttcaaggagctccctccatatgaccctgactggtactacaccagggctgcatccattgcaaggaagatctatctgaggcaaggcattggtgttggtggcttccagaagatttacggtggccgccagaggaatggctcccgcccaccacacttctgcaagagtagtggtgccatttcacgcaacatcctgcagcagctacagaagatgggcatcattgatgtcgatcccaaggcgggacggtcataccgccaggaaggcgtgatctggaccaagtggccggaagggttgctgttgaacttgagcagtctcatcttcggtttcaatgatgtcatgtttgagatggctgcactttttttgcacttttggattaaggttttttagttcggagaactttaaggttaatgcatctaactatggcgccacactatattttcctgagtacctatggatatccaaactcattctgggaaccaaagattgttg

SEQ ID NO: 471 - DNA, 776 bp, Saccharum officinarum
aaaccaggctcgccccacgcgtccggggggggcatccacatccacactacctgcctctctctcgttccgtggcggcggcggcggcggcggcggcggcaggatggcggcatctacggcgaggacggtgaaggatgtcaacccccacgagttcgtcaaggcctactccgcccacctcaagcgctccggcaagatggagctccctgagtgggttgacattgtgaagactgcgaggttcaaggagctccctccttatgaccctgactggtactacacccgggctgcatccattgcaaggaagatctacctgaggcaagggattggtgtcggtggcttccagaagatttacggtggccgccagaggaatggctcccgcccaccacacttctgtaagagcagtggtgccatttcacgcaacatcctgcagcagctgcagaagatgggcatcattgatgtcgatcccaagggcggaaggctcatcacgtcgcagggaaggcgcgatctggaccaagtggctggaagggttgctgttgaagcttgagcagtctcatcttcggtttctatgatgtcacgtttgatggttgagatggctacactttatttgcactttggattagggtttttgagttaagacaactttaaggttgaatgcatctagctatggcgccccactatattttccctgagtacctaatgcagtatttaaactcattctggaaccaaagaaatatgtttgcgaagtgtctgagctgatatcaatgaccagtcttccttttggt

SEQ ID NO: 472 - DNA, 824 bp, Helianthus annuus
ggggctagccagtttatcttcttcgcgcagtgcttaaacgcagcagcagcagctaccatggcgacggcgagaactgtgaaggatgtttctcctcatgaatttgtcaagggttacgccgctcacctcaaacgatctggcaagatggagcttcctgaatggactgatatagtgaagactgctacctttaaggagcttgctccctatgatcctgactggtactatatcagagctgcttcgattgctaggaaaatctacttgaggggcggtcttggtgttggcggcttccagagagtctacggtggacgtaagaggaatggcagtgctccaccacatttctgcaaaagcagcggtggtatcattcgccacattcttcaacaattggaaacaatgaaaatcattgatatggatcccaagggtggaagaagaatcacttcaaatggccgtcgagaccttgaccaagttgctgggagaatcgttgttgcaccttgaatagctcaatcatttgattctggtcatcatttttgatgctatgtagcttaatatttttagtaagaatgaacaaattttggttctttttgttttgaatcgtttgtgtttgctcttcttaaatgtcggcactggtaatttgagttgatctataatcatgtttgaactgattgctgttgtttcgtttacattcaagaataagtttttttatagaaaaaaatgacataaaaaaaaaaaaacgccctggtgcgccccccttgtcccaagcccattttagaattgagacagctttatgctttgcggccccaatttgagctccattttgccaattcccccct

SEQ ID NO: 473 - DNA, 666 bp, Helianthus annuus
acgcggggctagcttatatatctttgtatacaggtcgaaagtgccaacgcagcagctacaatggcgacggcgagaactgtgaaggatgtttcccctcatgaattcgttaagggttacgccgctcacctcaaacgatctggaaagatggagcttcctgaatggactgatattgtgaagactgctacttttaaggaacttgccccctatgaccctgactggtattatattcgagctgcttctattgctaggaaaatttatctgaggggtggtattggtgttggtgcgttccagagaatctatggtgggcgtaagaggaacggtagtgctccaccacatttctgcaaaagcagcggtggtatcattcgtcatatccttcaacaactggaaacaatgaaaatcattgatatggatcccaagggwgggagaagaatcacttcaagtggtcggcgggaccttgatcaagttgctgggcgaattgttgttgctgtttgattccagtcatatttttttatgttatgtagcttatacatttagcatgaaggaacaaattttggttgttttttgtttggtgcatttgtggatttggctttctgttttgaatatcagtacttgtatgagttaattcactgtattcgtgtttgagttaattgagaagttggcttcatg

SEQ ID NO: 474 - DNA, 719 bp, Panicum virgatum
gggtccccccagcacaagcacacgcacaagcccaagcaggatggcgacctcgacggcgaggacggtgaaggatgtcaacccgcacgagttcgtcaaggcctactccgcgcacctcaagcgctccggcaagatggagctccctgagtgggttgacattgtgaagactgcgaggttcaaggagctccctccttatgaccctgactggtactacaccagggctgcctctattgcaaggaagatctacctgaggcaaggcattggtgtgggtggattccagaaaatctacggtggccgccagaggaatggttcctgtccgccgcacttctgcaagagcagtggcgccatttcacgcaacatcctgcagcagttgcagaaaatgggcatcattgatgttgatcccaagggtggacggctgattacttcccagggaaggcgtgatctggaccaagtggctggaagggttgctgttgaagcttgagcagtatcatcttctgtttgaatggtgtcgtgtttgatggttgagatggctactatatttgcagttttgaattaggacttgtaccaccttttttgtttagagaatttaatgttaatgcatctagctatgaagcagcacactatatcttcgctgaggatctaatgcaatgtctgaactcctgaaccagagaaatttgtttgcgactgagctgatatccataatgtgttttgcttctcgtaca

SEQ ID NO: 475 - DNA, 723 bp, Panicum virgatum
ccccgagcagccgcagcggccagcacttcacgtcccctgcctccctctcgtcacctggcggcggcggcggcggcggcagcggcaggatggcggcttcgacggcgaggacggtgaaggatgtcaacccgcacgagttcgtcaaggcctactccgcccacctcaagcgctccggcaagatggagctccctgagtgggttgacattgtgaagactgcgaggttcaaggagcttcctccttatgaccctgactggtactacaccagggctgcctcaattgcaaggaagatctacctcaggcaaggcattggtgtaggtggattccagaagatctatggtggccgccagaggaatggctcccgcccaccacacttctgcaagagcagtggtgccatttcacgtaacatcctgcagcagttgcagaagatgggcatcattgatgttgatcccaagggtgggcggctcatcacctcccagggaaggcgtgatcttgaccaagtggctggaagagttgctgttgacgcttaagcatctctgttttctgttttgtccgtgttcgatggtatggctacactttatttgcagttttgaactaggacttgtcctgccttggttcagagaatttaagatttgatgcatctagttatggaactgcactatgttttcctcaagtacctaatgcagtattggaattcattctggaatgaaagtaaggaattgtgcttgt

SEQ ID NO: 476 - DNA, 845 bp, Panicum virgatum
gcccagcagccgcagcggccaccacttcgcgtcccctgtctccctctcgtcacccgtcggcggcggcggcagcggcaggatggcggcttcgacggcgaggacggtgaaggatgtcaacccgcacgagttcgtcaaggcctactccgcccacctcaagcgctccggcaagatggagctccctgagtgggttgacattgtgaagactgcgaggttcaaggagctccctccttatgaccctgactggtactacaccagggctgcctcaattgcaaggaagatctacctcaggcaaggcattggggtgggtggattccagaagatctatggtggccgccagaggaacggctcccgcccaccacacttctgcaagagcagtggtgccatttcacgcaacatcctgcagcagttgcagaagatgggcatcattgatgttgaccccaagggtgggcggctcatcacctcccagggtaggcgtgatcttgaccaagtggctggaagagttgctgttgacgcatgagcatctcagcgttctgttttgatgatgtccgtgtttgatggttaagatggctacactttatttgcagttttgaactaggacttgccctgccttgctggttcagagaatttaagatttaatgcatctagttatggaactgcactatgttttccccaagtacctaatgcagtattggaactcattctggaatgaaacaaaggaattgtgcttgtgatgtgaatgagcagcccatgtcttgccatgttgattagatgaatacgttatactgttttaccaaactttgatcgtgaagattataattggaaattttatgtatgcagttgttgtt

SEQ ID NO: 477 - DNA, 709 bp, Panicum virgatum
aaaccctagccccgagcagccgcagcggccagcacttcacgtcacctggcggcggcggcggcagcggcaggatggcggcttcgacggcgaggacggtgaaggatgtcaacccgcacgagttcgtcaaggcctactccgcccacctcaagcgctccggcaagatggagctccctgagtgggttgacattgtgaagactgcgaggttcaaggagcttcctccttatgaccctgactggtactacaccagggctgcctcaattgcaaggaagatctacctcaggcaaggcattggtgtaggtggattccagaagatctatggtggccgccagaggaatggctcccgcccaccacacttctgcaagagcagtggtgccatttcacgtaacatcctgcagcagttgcagaagatgggcatcattgatgttgatcccaagggtgggcggctcatcacctcccagggaaggcgtgatcttgaccaagtggctggaagagttgctgttgacgcttaagcatctctgttttctgttttgttcgtgttcgatggtatggctacactttatttgcagttttgaactaggacttgtcctgccttggttcagagaatttaagatttgatgcatctagttatggaactgcactatgttttcctcaagtacctaatgcagtattggaattcattctggaatgaaagtaaggaattgtgcttgtg

SEQ ID NO: 478 - DNA, 757 bp, Panicum virgatum
ggccccccatccatccgaaccccgtcgtaccatacaaaccctagctagctagctagctagcccagccgcaccgcagcgccccagcaccagcaggatggcgacttcgacggcgaggacggtgaaggatgtcaacccgcacgagttcgtcaaggcctactccgcgcacctcaagcgctccggcaagatggagcttcctgagtgggttgacattgtgaagactgcgaggttcaaggagctccctccttatgaccttgactggtactacaccagggctgcctcgattgcaaggaagatctacctgaggcaaggcattggtgtgggtggattccagaaaatctacggtggccgccagaggaatggttcctgtccgccgcacttctgcaagagcagcggtgccatttcacgcaacatcctgcagcagttgcagaaaatgggcatcattgatgttgatcccaagggtggacggctcattacttcccagggaaggcgtgatctggaccaagtggctgggagggttgctgttgaagcttgagtagtatcatcttctgtttgaatggtgtcatgtttgatggttgagatggctactatatttgcagttttgaattaggacttgtactaccttttttgttctgagaatttaatgttaattcatcgagctatggagcagcactatatctttgctgaggatctaatgcaatatcagaactcctgaaccagagaagtgtttgagctgatatacataatgtgttttgcttct

SEQ ID NO: 479 - DNA, 863 bp, Camellia sinensis
tatcggccattacggccggggacccacgcaaaccctagttggagctcaggaggaagatctgccgccgcagaggaaccgaagcagaagcagaaaatggaggctgcgagaactgtgaaagatgtctctcctcacgagttcgtcaaggcctacgccgctcacctcaagcgctccgggaagatggagcttcctcactggactgacattgtgaagactgcaaaattcaaggagcttgccccatatgaccctgattggtactacattagagctgcttctatggctaggaaaatctaccttagaggcggtcttggtgttggtgcttttcagaggatatatggagggagccagaggaacgggagtcgcccaccccatttctgcaagagcagtggagccattgcacgacacatcctccagcaattgcagaacatgaacattgttgactttgactccaagggtgggaggaaaatcacatcaagtggccagagagatcttgatcaagttgccggaaggattgttgcggtggttgctcaatgagagagagaaaatcgagtgcctttatgcgtacattaaatactctggatttatagtagtagtcgttttggatgagaagagtatatttggagtactgttaaaatcaattttccgcttggttgcatggtgcccctacattgaacattggctgtttgttatttttggattcattgttcttgttgactcgtgttttttcaattttccgtagttccaaaaccgtttttattttggtgttattctattcttgtttgcctacttatagttctacacttgggaatgttttgtttcaacctaacaatgtttgtgccatggacaaaactctatagctttttctg

SEQ ID NO: 480 - DNA, 771 bp, Juglans hindsii x Juglans regia
gggggcgagcgagagagagagagggccaacttcgtcgcccccaagcgattagcctccctcacctgtgcgacccaagcctctctaccttgmttcatcaatggcgacmgcgacgactgtgaaggacgtttcgcctcacgagttcgtgaaggcttactcggctcatctmaagcgatccggcaagatggagctgccrgagtgggcagatattgtgaagactgcaaggtttaaggaactggctccttatgaccctgattggtattatgtgagagctgcctccatggcaaggaagatctacctgaggggaggtcttggtgttggttcttttagaaggatttatggtgggagtcagaggaatggaagtcgtccaccccatttctgcaagagcagtggttctgttgctcgccacattctacaacagttgcagcaaatgaacattattgacgttgacccaaagggtggaaggagaatcacctcaactggtcagcgggaccttgaccaagttgctgggaggatcgttgttgccccctgatcaatgtattcgagagatctggtagagcattggtcttactattttaggtttctacttttgttgaaaaatgtggcaactactactgcgaatgtatcaagacaacattttgtcccatctgccaagtgtttagttaagatagacgtggttgatgttttggtttcaaattttggtgctttgacaacctatttttactcaattatctataatttgatatgtttagtctatcattcaagatttcatgc

SEQ ID NO: 481 - DNA, 807 bp, Juglans hindsii x Juglans regia
ggggcttgcgagcgagagagagcgagagaaagagaggagtcatctgcttcggcacccccagcgatcaagcctccctcacctgtgtgacccaagcctctcaccttgcttcggctatggcaaccgcgacgactgtcaaggacgtctcaccccacgagttcgtgaaggcctactcggctcatctcaagcgatccggcaagatggagctgcctgagtggtcggatattgtcaagactgccaagttcaaggagctggctccctatgaccctgactggtattttgtgagagctgcctccatggcaaggaagatatacttgcggggaggtcttggtgttggttctttccaaaggatttatggtgggagtcagaggaatggaagtcgccctccccatttctgcaagagtagtggtgctgttgctcgccacattctacaacagttgcagaaaatgaacattattgatgttgacccaaaaggtgggaggagaatcacctcaactggtcagcgggatctcgaccaagttgccgggcggatcgtggttgccccttgatcaattgacgcatgaggtctggtgggagcactttttgtttgttggagaaatgtggcaacgactgagttaagacaattttttgttcctgctgctgagtgtttcattaggatagaaatggttgatgtcttcttttcaagtttggtgctttgacatttagcgactcgaaatttatctagatgtcgagggttaaaagggtattagagtgggttatgtcttttgacaatcatttcttacaattttattaactattcaaggtttcgta

SEQ ID NO: 482 - DNA, 803 bp, Triticum aestivum
aaaaccctagccctcgcagccgcagcggcgcgcacacctctccctcctccctgaagacagcgccgccgtcggcgagagcacaggatggcgaccgtgcccgctcccgcagccgagaccgcggcctccacggcgcgcacggtgaaggatgtcaacccccacgagttcgtcaaggcctactccgcgcacctcaagcgctccggcaagatggagcttccggagtgggttgacattgtcaagactgcaaggttcaaggagcttccaccttctgatgctgactggtactacatcagggctgcctcgatggcaaggaagatctacctgaggcagggaattgggatcggcggcttccagaagatctacggtggccgtcagaggaatggttcacgcccaccgcacttctgcaagagcagtggtgctgtgtcccgcaacatcctccaggagttgcagaagatgggcatcattgatgtggaccccaagggtggaaggctcatcacctcccagggaaggcgtgatctggaccaggttgcaggaactgttcctgccgaattctgatcagttgaagtcccctctatgcaatcgtgttcggtagtagaatttggctacagttttgaattatgatacccccctgtgtttgttatccaagacttcgttgaagtagatcgcatgctattctggtacaatggttattgtctgagcttttaaattatctgcccgcctgggagaatcttatgcttgtgagttcttgtcataaagatggattttactccttgcgtgaatgtgatgttagtgattggcctgtcgta

SEQ ID NO: 483 - DNA, 803 bp, Triticum aestivum
caaccctagccctcgcagccgcagcggcgcgcacccctctccctccttcctgaagacagcgccgccgtcggccagagcacaggatggcgaccgtccccgctcccgcagccgagaccgcggcctccaccgcgcgcacggtgaaggatgtcaacccccacgagttcgtcaaggcctactccgcgcacctcaagcgctccggcaagatggagcttccagagtgggttgacattgtcaagactgcaaggttcaaggagctgccaccttctgatgctgactggtactacatcagggctgcctcgatggcaaggaagatctacctgaggcagggaatcgggatcggcggcttccagaagatctacggtggccgtcagaggaacggttcacgcccaccgcacttttgcaagagcagtggtgctgtttcccgcaacatcctccaggagttgcagaagatgggcatcattgatgtcgaccccaagggtggaaggctcatcacctcccagggaaggcgcgatctggaccaggttgctggaactgttcctgccgaattctgatcagatgaagtcccctctatgcaatcgtgttcggtagtagaatttggctacagttttgaattatgataccctccctgtgtttgttatgcaagacttcgaagtagatcgaatgctattatggtacaatggttaattgtctgagcttttaaattatctgcccgcctgggagaatcttatgcttgttcttgtgataaagttggatttttctcctgacgtgaatgtgatgttagtactgcgtattgtatcatttct

SEQ ID NO: 484 - DNA, 788 bp, Triticum aestivum
gaaaaaccctagccctcgcagccgcagcggcgcgcacacctctccctccttcctgaagacagcgccgccgccggccagagcacaggatggcgaccgtccccgctcccgcagccgagaccgcggcctccacggcgcgcaccgtgaaggatgtcaacccccacgagttcgtcaaggcctactccgcgcacctcaagcgctccggcaagatggagcttccagagtgggttgacattgtcaagactgcaaggttcaaggagctgccaccttctgatgctgactggtactacatcagggctgcctccatggcaaggaagatctacctgaggcagggaatcgggatcggcggcttccagaagatctacggtggccgtcagaggaacggttcacgcccaccgcacttctgcaagagcagcggtgctgtttcccgcaacatcctccaggagttgcagaagatgggcatcattgatgtcgaccccaagggtggaaggctcatcacctcccagggaaggcgtgatctggaccaggttgccggaactgttcctgctgaattctgatcagttgaagtcccctctatgcaatcgtgtttggtagtagaatttggctacagttttgaattatgatacccaccctgtgtttgttatgcaagactttgttgaagtagatcgcatgctatcatggtacaatggttattgtctgagcttttaaattatctgcccgccagggagaatcttatgcttgtgagttcttgtgataaagttggattttactccttgcgtgaatgtgatgtt

SEQ ID NO: 485 - DNA, 624 bp, Triticum aestivum
cgcatcccactacctgcctctctctctctcgtcccctggcggcggcggcggcggcgacaggatggcggcttccacggcgaggacggtgaaggatgtcaacccccacgagttcgtcaaggcctactccgcccacctcaagcgctccggcaagatggagctacctgagtgggttgacattgtgaagactgcgaggttcaaggagctccctccttatgaccctgactggtactacaccagggctgcatctattgcaaggaagatctacctgaggcaaggcattggtgtgggtggcttccagaagatttatggtggccgccagaggaatggctcccgtccaccacacttctgcaagagcagtggtgccctctcacgcaacatcctgcaacagctgcagaagatgggcatcattgatgtcgatcccaagggtggaaggctcatcacatcccagggaaggcgtgatctggaccaagtggctggaagggttgctgttgaagcttgagcagtctcatcttcggtttctatgatgtcatgtttgatggttgagatggctacactttatttgcatttttggattaggactttttaggtcagagagctttaaggtttaatgcatctaggtatggc

SEQ ID NO: 486 - DNA, 607 bp, Triticum aestivum
acggcggcggcggcggcaggatggctgattcgacggcgaggacggtgaaggacgtgaaccctcatgagttcgtcaaggcctactccgcccacctcaagcgctccggcaagatggagctccctgagtgggttgacatcgtgaagactgcgaggttcaaggagctccctccttatgatccggactggtactacacgagggctgcctcgattgcaaggaagatctacctgaggcagggtattggtgtaggtggcttccagaagatctatggtggccgccagaggaacggctcacgccccccgcacttctgcaagagcagcggcgctatctcacgcaacatccttcagcagctgcagaagatgggcatcattgatgtcgacccgaagggtggaagactcatcacctcccagggaaggcgtgatctggaccaagtggccggaagagttgatgttaccatcgcctgaacagattcattgatcctcaacccttaatgcctgtcatgtttggtggttgagttggctacagtttgtttgcagttttgaattagaacatgccctatctttgttggctcagagaattggaagttggatgcatctagttatgatattgc

SEQ ID NO: 487 - DNA, 1620 bp, Brassica napus
gacacgttgaagaaggagaagtagagtgttctgagtatcgattgatttaactttcctggaaactggatctagatttcttcgtttctgagaagcaaaacagtaagtgatgaatctttatccgaacctgagaagagggacactactctctgtgctctacgtcgtcgttttgctgtgcaacgcctccacctccacttcgtattcttcatctgaagcgatcacaataaagccaagacacttatctttgcttaagagtgctttacaacggccaagtggggagcagtctgatctatggaagccaatgactgaccaaggatggagtccatgcatcgatctcgaagatcccccttcattaccggataagaccaaaagctatatccaagtgtttctcgacggaggacttaaccagcaacgaatgggtatatgcgacgcagtcgcagtcgctaagatcctaaacgcaacgctcgtgatcccgtttcttgaaatcaatcccgtttggcaagactcgagctcttttgttgacatcttcgacgtggatcactttatcgatgcgttaaaagatgacgtaagagtagttaaagagcttcctgaggactactcttggagcacgagagagtactacgctgcggcggttcgtgaaacacgtgtcaaaaccgctcctgttcacgcttctgcgcaatggtatattgagaatgtttcaccgcttcttcacagctatgggattgctgcgatctctccgttctctcaccgtctgtcgtttgatcacttacctggtgagattcaacggctgagatgcaaagtgaacttccaagcgttgaggtttgttcctcacattacatcgcttggtgatgctcttgtgagccgtcttagaaacccgttgtggagaagcgaaaaggacagaaagagtgtggatcatttgggagacatgacgaatccgaacagtagacatgaaccagggaagttcgctgttcttcatcttcgctttgacaaggacatggctgcacattcggcgtgtgactttggtggaggcaaagcagagaaacttgcattggcgaagtaccgacaaatgatttggcaaggaagagtgttgaactctcagttcacagacgaagagctaagaagtcaaggacgttgtcctctaacacctgaagagatgggacttctcttagccgctttcggtttcgacaacaacactcgtctctatctcgcttcccacaaggtatatggaggagaagctaggatctcagcactaagacaagtcttcccaaggatggaagacaagagaagcctagcttcttctgaagaacgagctcgtatcaaaggcaaagcttctttactagctgcacttgattactacgtgagcatgcacagcgacgtgttcatctctgcgtcgcctggaaacatgcacaacgctctcgttggtcataggacgttcgagaatctcaagacgattagaccgaacatggcgttgataggacagcttttcttgaacaagagcattacttgggtggattttcaacaggcgattggtgaaggacatgtgaatagacaaggacagatccggttaaggaaaccgaaacagtctatttatacttatccggctcctgattgtatgtgccatgt

SEQ ID NO: 488 - DNA, 1658 bp, Raphanus sativus
ggggtttctcgtttctactctcgcctgagaataaaggatgagtctttacgccaaagacagaacgattctctctgcgctgttattcgtcgtcgttttgatttgcaacgcttcgacttcgtcttcagcatctgaagcaatcacaataaagccaagacatttatctttgctaaagagtgctttacaacggccaagtggagaacagtctgagctatggaggccaatgcctgatcaaggatggagtccatgtcttgatttrggaaactccccttcattaccagakaaaagcgagggatatattcaggtgtttctagatggaggacttaaccagcaacgaatggggatatgtgatgcagttgctgttgccaagatcttaaacgcaacgctcgtgatcccttatctygaagtgaatcctgtttggcargactccagctcttttgttgatatctttgatgtggatcattttatcaattccytaaaggatgacataagggtagttagagaacttcctgaggaactctcttggagcacaagagagtattacagcatagcggttcgtgaaacccgagttaaaaccgcgcctgttcatgcttctgctaaatggtataaagagaatgtctcrcccgttcttcaaagttatgggattgctgctatttctccgttctctcaccgtctatcgttcgatcacttacctgctgagatccaacgtctaagatgcaaagtaaacttccaagctttacgctttgtccctcacattacatcgcttggtgacgctctcgtgagccgtcttagaaacccgttgtggagaagcagcaaggatagaaagaagaacgtggatcatttaggagacatgacaaactctcacagcagacgagagcctgggaaattcgccgttcttcatcttcgtttcgacaaggacatggctgcgcattcggcgtgtgattttggtggaggcaaagcggagaaacttgcgttggccaagtataggcaaatgatatggcaaggaagagtgttgaactctcagttcacagatgaagagctgagaagtcaaggacggtgtccgctaacacctgaagagatgggacttcttctggctgctttcggtttcgacaacaacactcgtctctacctagcgtctcacaaggtgtatggaggagaagctagaatctcagcactaagacaagtattcccaagaatggaagacaaaagaagccttgcttcctctgaggaacgagctcgaatcaaaggcaaagcttctttattagccgcacttgattactacgtaagcatgcacagcgacattttcatctctgcatcgcctggaaacatgcacaacgctctcgtgggtcatcgaacgttcgagaatctcaagactattcgaccaaacatggctttgataggacagcttttccttaacaaaagcatcacgtgggtcgatttccaacaggcgcttggggaaggacacgtgaacagacaaggacagatccggttaaggaaaccgaaacagtcgatttatacttatccggctcctgattgtatgtgccatgtctgatttgatagtcctttagattgttttctgataataaaagctcggttctttgacgagagaggctgctttggtttttacttgagaggaggcttaataaaaatatagttgcatt

SEQ ID NO: 489 - DNA, 697 bp, Raphanus sativus
ggggaccaaagcttcttactctgaagaaaagagagaggaaaaaaacaaaaacaaaatggagaatcygytaggccttctaagrcttcatgtgattagaggtgttaatctcgccattagagattctaraagtagcgatccttacgtcattgttcgtatgggtcaacagaaattacgaactcgtgtggtgaaaaagaatttgaatccagamtggaacgaggacttgacactctctatttctgatccaactcttcctatcaaaatcatggtttacgatagggactggttgtcaagggatgataagatgggagatgcggtttttcacattgacccattccttgaagtcatcaggatgaaaaaccagttcggaggactccccgaaggaaccgtaataatgaagatacaggcaagcaggcagaactgtctatcagaagagagcaagattgtgtggaacaaaggaaagattgtccagaatatgttccttaggctccagaacgttgagtgtggagaggtcgagcttcagcttgagtggatagatgtcycaggtcttgagcatgaggatgtwgcttactagatctatttttatattacaggaartttgttagaaagttttttartacatgacttttagagaaatttcttgtttcaaatcagctsacatttcaatmtaaaatwtattaactttttatgttatatccca

SEQ ID NO: 490 - DNA, 1536 bp, Arabidopsis thaliana
atggagattttgacgagcatggcgattatagtagtaacaacgatcttcatccttctgtctttcgcactctatctaactatcagaatcttcaccggaaaatccagaaacgacaagaggtatactcctgtacacgccacaatctttgatcttttcttccacagccacaaattatacgattacgagacagagatcgcgaggacaaagcctactttcaggttcttgagtccaggacagagcgagatattcactgcagatcctcggaacgtggagcatattctcaagacaagattccataactatagtaaaggacccgttggtacagtgaatcttgcggatcttctgggacatgggatcttcgctgttgatggagagaaatggaaacaacaaaggaagctcgtgagctttgagttctccactagagttttaagaaattttagctactctgtttttcggacaagtgcttctaagcttgtcggttttattgcggagtttgctctctctggaaaatcttttgattttcaggatatgttgatgaaatgtacattggactccatctttaaagttggattcggtgtggagttaggatgtctagatgggtttagcaaagaaggggaagagttcatgaaggcttttgatgaaggcaacggcgcaactagttccagggtcaccgacccgttttggaagctgaaatgttttcttaacattggatcagagtcaagactcaagaagagcattgctattatagacaagtttgtctatagtctcattaccactaaaaggaaagagctttccaaggaacagaacacttctgttagagaggacatcctatcgaaatttcttctcgagagtgagaaagatccggagaacatgaatgataagtacctgagggatatcattttgaatgttatggttgctggtaaggacacaaccgctgcatcactctcttggttcttgtacatgctctgcaaaaacccacttgttcaggagaaaatcgttcaagaaatcagagatgtgacatcaagtcacgagaaaacaaccgatgtaaatggtttcattgaaagtgtaaccgaagaagctcttgctcagatgcagtatctccatgcggccttgtctgagactatgaggctttacccacctgtgcctgagcacatgaggtgtgcagaaaatgatgacgttcttccagatggacatagagtgagcaaaggggataatatctactacatatcctatgcaatgggtaggatgacttacatttggggtcaagatgctgaggaattcaagccagagagatggctcaaggacggcgtattccaacccgaatcacaattcaaattcataagctttcatgctggtccaagaatctgtattggcaaggatttcgcataccggcagatgaagatagtatcaatggcacttcttcacttctttcgcttcaaaatggctgatgagaacagcaaggtgtcttacaagaaaatgcttacacttcatgtcgatggaggactacatctctgtgcaatcccgaggacaagcacttga

SEQ ID NO: 491 - DNA, 319 bp, Arabidopsis thaliana
atgggtattacaaagacttcagtgacttttttattcttattaatattggctgcttttgtatccaattacaacgtattggcttcagagatcaaacctacagggagaattgatgatcaatgcaagcagatgtgttcggcaacgtacggggacggtaaatgtgcctcggactgtaggaaggctggtttctcatccggacgttgtctaacttcttctcctttcggaaataaatgttgttgcaccaagtgatacaaaccgatctatatgagttttctcttgttggattgccacaaaaaaatcataaattaaaaattccttaaca

SEQ ID NO: 492 - DNA, 2049 bp, Ricinus communis
atggaggctccgccaggaggatccgacagggagaaatcgaacccgagctcttctccaattcctgtcgtctccaatttctggaaagaatttgatttggagaaggagaaaattgtgttggatgaacaaggactgaggatagctgaaaaccaggaaaatagcctgaagaaccgacggaagcttgcggagagcactagagatttcaaaaaggcttcaccagaggaaaagttgagtttgtttaattcattattgaagggctaccaagaagaagttgataatcttaccaagagagcaaaatttggagaaaatgctttcctgaatatatatcagaagctttacgaggctccggatccgtatccagctctagcttcaattgctgatcaagatctgaaattgtctgaactagaatctgagaacaggaagatgaaagttgagcttgaggagttcaggacagaagctactcatttaaagaatcagcaggcgacaataagaagacttgaagaccgtaatcgtcagttagagcaacagatggaggaaaaagtgaaggaaatcgtggagatgaagcagcgtagtttggctgaagagaaccagaaaacactagaagttttgaaagaaagagagcaatctttgcaggatcaattacgacaagcaaaagaaagtgtttccaatatgcagaaattgcatgaacttgcacaaagtcagttgttcgaagttcatgcgcaatcagaggaagaaagggcagcaaagcagtcggaggtcaatcttctgatggatgaagtggaaagggctcaaacacgacttcttagccttgagagagagaagggtgtccttcgttctcaacttcaatcagcaaatgaagaaactggaaataagaaaagcgatagtctggattcaaataatgtgcttgagaatactttgagtgccaaagaaaagattatttccgaacttaacatggagctccacaatattgaaaccgccttgactaatgagcgggaacagcacattaatgaaatcaagaagttgaacatggtactcaatgagaaggaactttctattgaggagatgaagaaggagcttcaagcaaggccgactgcaaaattagttgatgacttgcgtaaaaaagtaaaaattctgcaggcagtgggctataattcaattgaggctgaagattgggaagcagctaccagtggggaagagatgagcaaaatggagtctcttcttcttgataagaatcggaaaatggaacatgaactcacacacttgaaggttaaactttctgagaaagagtctacgctggaaacagctgaaagcaagatagtagagcttagtgcaaaagttaatgaacaacaaaagttaatacagaagttggaagatgatatattgaagggttatagttctaaagatcaaaaaggtggtctttttgatgattgggatctttcagaggctgggcgcgtggagttatctgagaacgcagaccagaaacatgtgtcttcggatcaagaccagagctcaatgctaaaggttatctgcaaccagcgagatcgattcaggaaacgcttgcgagagacagaagaagaggtaaggcagttaaaggagaagatagggttactgacagcagaactagagaagtcaaaagctgataatgtcaaactatatggaaagatacgttatgtccaggattacaatcttgagaaagtcgtttccagaggatcaaagaagcaagcagaggacctggaaagtggcttttcctcagatgtcgagtccaagtacaagaagatatatgaagatgatataaatccatttgcagccttttccaagaaggaaagagatcaaagatacaaggaattgggattgagggatagaatcacccttagcagtggacgttttcttctcggcaacaagtacgctcgtacttttgcatttttctacacaattgggttacatatcctggtcttcacctgtctctacagaatgtcagctctgagttaccttagtcatggcgaggaatcctatacaggagagaaacaattgaacctccctcacgcactctag

SEQ ID NO: 493 - DNA, 2417 bp, Gossypium hirsutum
agaaagaaactttaaagatccaccaattcggttcaaggcttttacagatctacgaatcatccaaatatatcctaactcattctcgatcttattactctccttaccgctacttgaaatattggaattaattcaaatccttacaatccattttcaaccaacctaaaaccctagcatttggcgagatccgaattcccaaaaaatggatgctccgcaaggcggatccgacggcgacaaaaccaatccttcctcttctcctgtctccgttgtctccaatttctggaaagaatttgatctggaaaaagagaaaagtgtgcttgatgaacaaggactcagaatagctgaaaatcaggaaaacagccagaaaaataggcggaagcttgctgagagtacaagagatttcaagaaagctgcgccagaggaaaaattaagtttatttaattcattacttaagggctaccaagaagaagttgataatcttaccaagagggcaaaatttggcgagaatgcttttctgaacatctatcaaaagctttatgaggctcctgatccttatcctgctcttgcttcaatttctgagcaagatctaaaaatctctgaattggaatctgagaaccggaaggtgaaagttgagcttgaagagttcagaacagaatcaatgcacttaaaaaatcagcaggcaacgataagaagacttgaagagcggaatagacaattagagcagcagatggaggaaaaagtgaaagaaattgtggagatgaagcagcgcagtttagcagaagaaaaccagaaaactctagaagtcttaaaagacagggagcaatctttgcaagatcaattacggcaagctaaagaaagtgtatcaaacatgcaaaaactgcatgaacttgcacagagccagttgtttgaacttcgtgctcagtcagaggaagatagggcagcaaagcaatctgaggtcaaccttttgatggatgaagtagagcgagcccaaactcggctttttagtctggagagagagaaggggcttctacgctcacaattgcagtcagcaaatgaagagtcagaaaacaagagaagtgatgtagattcaaatgccatacttgaaacctccctaagttccaaagaaaagataatctctgagctgaacatggaacttcacaatattgaaactacgttatccaatgaacgagtgcaacatgtcaacgagatcaagaagttgaattcgttgctcaatgaaaaggatgttgctcttgaggagatgaagaaagaacttaaagcaaggccaacagaaaagttggttgatgatttgcgtaagaaagtgaaaattttgcaggcagtgggttataattcaattgaggctgaagattgggaagcagctaccagtggggaagagatgagtaaaatggaatctcttcttcttgataaaaataagaaaatggaacatgaacttacacagctgaaggtsaaactttccgagaaaacatcttttctggaaacagctgaaggcaaaatagtagaactcgcggaaaaggttaatgaacaacaaaagctgatacagaaattagaagatgatatattgaagggttatagttccaaagaaaagaaaggaactctttttgatgattgggatctttcagagagtggagggaatgaactttccgagaacacagatcagaaacaagtttccgcagatcaagaccaaagctcaatgctgaaggtgatctgcaatcagcgtgatcgatttagggcacgtttgcgggaaactgaagaagaaataaggcaattaaaggagaagataggggagctaacaacrgaactggagaaaacaaaagctgataatgttaaactttatggaaagattcgttatgtccaggattataaccaggagaaagtaatttctagaggatcaaagaagtatgccgaggatcttgaaagtggtttcacctcagatgttgaatccaagtacaagaagatatatgaggatgatattaatccctttgcagcattctcaaaaaaggagagggatcaaagatacaaggagctgggcttcagagacagaatcacactcagcagcggacgttttcttctgggaaacaagtatgctcgaacrtttgcatttttctacacaattggtttgcatatcctagtgtttacttgtctataccgaatgtccgctctaagctacctcagccatggctctgaggaaactgccgtcgttgagaaaaacttgaaccttccgcgtggatattagtgacatctacccttagccatttcttcatttatggtttgttcttgtgagaagaatatggcattgaaattaaatttacaaacttaataaactgtacatgtaacacaatcatgttatgttcaaaatagctaatactatacatccatgtctttcgatcttaagtttttgctca

SEQ ID NO: 494 - DNA, 2361 bp, Glycine max
atggaggctccacaaggtggatccggatccggacccgagcgagacaaatccaccgctccctcctcttctccgatctccgtcgtctccgccttctggaaagattttgagttggagaaggagaaatctatactggatgagcaagggcttcgaattgctgagaaccaggaaagcagtcagaaaaatcgccgcaagcttgccgagaacactagagacttcaaaaaggcttcgcctgaggataagttaagtttgttcaattccttgcttaagggctatcaggaagaggttgacaatcttacgaagagagcaaagtttggagaaaatgcttttctcaacatctatcaaaagctctatgaagctccagatccttatccagctcttgcgtcaattgctgagcaagatctcaagatatctgagcttgaatctgaaaaccggaaaatgaaagttgagcttgaggagttcaggacagaggcaactcacttgaagaatcagcaggctacaatacgacgacttgaagagagaaacaggcaattagagcaacagatggaagagaaagtgaaagaaattgtggagattaagcaacgcagtctggcagaagagaatcagaaaacattggaagttttgaaagaaagggaacaggcactgcaagatcagttgcagcatgccaaagacagtgtctctactatgcagaaattgcatgaactcgcacaaaaccagttgtttgaactccgtgcccaatctgaggaagagagggcatctaagcaatcagaagtcaatcttctgatggatgaagtggagcgtgcacaatcaatgcttcttagtttagaaagagagaagggggttctccgatctcagttacaaacggcaaatgaagagactgaaactaagaatagtgataattttgactcaaatagtgcacttgagaattctttaaatgccaaagaaaagcaaatctctgaattgaacatggagctacacaatattgaaacagccttatcaaatgaaagagatcaacacattaatgaagtcaagaaacttactgcaatgctcaatgaaaaggaggctgcccttgaggagatgaagaaagaacttaaagcaaggccaacagaaaaaatggttgatgatctgcgcaagaaagtgaaaattttgcaggcagtgggttataattcaatcgaggctgaagactgggaagtggctacaagtggggaagagatgagcaagatggagtctcttcttcttgataagaaccgtaaaatggaacatgaactaacacagttgaaggtcacactttctgagaaaacatccttactggaaacagctgaacagaagatagcagagcttacagcaaaggttaatgaacaacaaaaattggtacagaagttggaagatgatattttaaagggatatagttccaattcaaaagatcgtaaagggaacttccttgatgattgggatctttcagaagctggtgggggtgaggtttctgagaatacagaccaaaggcaagtatccttagaccaagatcagagctcaatgcttaaagtgatttgtaatcaaagagatcgatttaggacccgcttgcgagagacagaagaggaaataaggcagttgaaggagaagattggggtattaacagtggaactggaaaagagcaaagctgataatgtcaaactatatgggaagattcgttatgtacaagactataatcatgagaaagtgatttctaggggttctaaaaagtatgctgaagatcttgaaagtggtttcgcgtcagatgttgaatctaaatacaagaagatatatgaggatgatataaatccttttgctgcattctcaaaaaaggaaagggatcaaagatacaaggagttgggattcagggacagaattacacttagcagtggacgttttctccttggcaacaagtatgcccgaactttcgcattcttttataccattggattgcatatcttggtcttcacctgtctctaccgaatgtctgctctcagttatcttagcaatggcccagaggaattccttgttggagagaaaaacgttgatcttccgcgtggaccctagtggatatgcaactcagttttcagctgttgatttctcaaattgaacattacatgtggtcgaaatgcaacctcttttcaatggtcattttcaactcaattttcagtgatcgatttctcaaattgaacggtgcacatggtcggtgtgcatcctcttttcagtggtcttttttaacagatggaacgatagcatattgtcaatattaaaatatcaaatgtgttgtacatatatgactgtgttttactctaacaatgttgcaatgaaatatagaggcatttttttttcttaaac

SEQ ID NO: 495 - DNA, 2376 bp, Glycine max
gacactgcaccagaaatggaggctccaccaggtggatccggatccggatccggacccgagcgagataaatccaccgctccctcctcttctccgatctccgtcgtctccgccttctggaaagattttgagttggagaaggagaaatctatattggatgagcaagggcttcgaattgcagagaaccaggaaaacagtcagagaaatcggcgcaagcttgcagagaacactagagacttcaaaaaggcttcgcctgaggataagttaagtttgttcaattccttgcttaagggctatcaagaagaggttgataatcttactaagagagcaaagtttggagaaaatgcttttctcaacatctatcaaaagctctatgaagctccggatccttatccagctcttgtgtcgattgctgagcaagatctcaagatatctgagcttgaatctgaaaaccggaaaatgaaagttgagcttgaggagttcaggacagaggcaactcacttgaagaatcagcaggctacaatacgaagacttgaagagagaaacaggcaattagagcaacagatggaagagaaagtgaaagaaattgtggagattaagcaacgcagtctggcagaagagaatcagaaaacaatggaagttttgaaagaaagggaacaggcactgcaagatcagttgcagcatgccaaagacagtgtttctactatgcagaaattgcatgaactcgcacaaaaccagttgtttgaactccgcgcccaatctgaggaagagagggcatctaagcaatcagaggtcaatcttctgatggatgaagtggaacgtgcacaatcaatgcttcttagtttagaaagagagaagggggttctccgaaatcagttgcaaacggcaaatgaagagactgaaactaagaatagtgataattttgactcaaatagcgcgctggagaattctttaaatgccaaagaaaaacaaatctctgatttgaacatggaactacacaatattgaaacagccttatcaaatgaaagagatcaacacattaatgaagtcaagaaacttacggccatgctcaatgaaaaggaggctgcccttgaggagatgaagaaagaacttaaagcaaggccaacagaaaagatggttgatgatctgcgcaagaaagtgaaaattttgcaggcagtgggttataattcaatcgaggccgaagactgggaagtggctacaagtggagaagagatgagcaagatggagtctcttcttcttgataagaaccgtaaaatggaacatgaactaacacagttgaaggtcacgctttctgagaaaacgtccatactggaaacagctgaacagaagatagcagaacttacagcaaagtctaatgaacaacagaaattgatacagaagttggaagatgatatattgaagggatatagttccaattcaaaagaccgtaaagggaacttccttgatgattgggatctttcagaagctggtgggggtgaggtttctgagaatactgaccaaaggcaagtatccttagaccaagatcagagctcaatgcttaaagtgatttgcaatcaaagagatcgatttaggacccgcttgcgagagacagaagaggaaataaggcagttgaaggagaagattggggtattaacagtggaactggaaaagagcaaagttgataatgtcaaactatacgggaagattcgttatgtacaagactataatcatgagaaagtggtttctaggggttctaaaaagtatgctgaagatcttgaaagtggtttcatgtcagatgtggaatctaaatacaagaagatatatgaggatgatataaatccttttgctgcattctcaaaaaaggaaagggatcaaagatacaaggagttaggattcagggacagaattacactcagcagtggacgttttctccttgggaacaagtatgcccgaactttcgcattcttttataccattggattgcatatcttggtcttcacctgtctctaccgaatgtctgctctcagttatcttagcaatggcccagaggaattccttgtcggagagaaaaacgttgatcttccgcgtggaccatagtggatatgcaactcagttttcagcgattgatttctcaaattgaacagtacatgtggtcgaaatgaaacctcttttcagtggtcattttcaactcaattttcagtggtcgatttctcaaattgaacggtgcacatggtcggtgtgcaacctcttttcagtggtctttttttacagacagaacgataacatattgtcaatattcaaatatcaaatgtattgtacatatgactgttgttttactctaacaatgttgcaatgaaatatagaggcattttttttttc

SEQ ID NO: 496 - DNA, 1656 bp, Brassica napus
gagagaagagtcctctctcctctctctctctctctctctctctcttggtttaactgaaactatgcaatctggcggcgattacaccaacggtttccacggcgagcttcaacgggaggagaagcaagtccccgttctcagcdctcttgggcgagccaagaggcgcagtcgcggcggagctcgtgaccctagaggcggtctcaccaatggtgagcttagggtttccgaccagattagcgagcagaagccactggagactcaggaatctcctccgccttgtaccgacttcgatgtcgcctattttcattcctatgctcacgttgggattcacgaagagatgatcaaggatcggtcaaggacagagacttatagggaagcgataatgcagcatcagagctttatccaaggaaaggttgtggtggacgttggctgtggaacaggcatcctttcaatcttctgtgctcaggccggtgctaaacgggtatatgctgtagatgcaagtgatattgcagtccaggcaaatgaagttgtaaaagccaacggtttatctgacaaggtyattgttttgcatggragagtggaggatgttgaaatcgacgaggaggttgatgtkataatttcagagtggatgggttacatgctcttgtatgagagyatgctgggaagtgttattacagctagagatcgctggttgaagcctggaggtttaattctcccatcacatgcmacwttgtacatggcacctatttcacaccctgacagatacagtcacagcattgatttttggcgcaacgtttatggaattgatatgtctgcaatgatgcaactagcaaaacagtgtgcatttgaagaacctagcgtggagtccatatcaggcgagaccgttcttacatggcccgaagtggttaaacatatagactgtcaaacaataaaaatccaagagctagactctgttactgcaagatacaagttcaagtcaatgatgagagctccaatgcatggttttgcattttggtttgacgttgagttcagcgaacctgccaagaatactaatgcaacaagcrttgctaatgggtcctcatcaataagtccttttaccgaaggaaatcagaagaagcggagtaatccgagtgatgcactcgtgctgtccacctctcctgaggctcctccgacgcattggcagcaaacgattgtatatttctatgatccaatagacgtagagcaagaccaagtcattgaaggttccgttactctttctcaaagtaaagagaatcggaggttcatgaacatccacctcgaatattcctcggccggccgttcctttgtgaaggagtcggtaatgcgttaagaaggcgagagattctctgacaatatctccttaatttagaagctctgtaaggttgagtctcttttgctaaagcaatcattagttcagaactgaaacccgaagacataggcaaacacaagctattgttagtcatatgttcttgtaagagtattaagttttagatcagatggaagcaactataggacattgttcttgaagccatttagcttctttactagtaactcaacatagcatacttctatatgattgcttttattgatcatgcattttatttgtacttttgtgtaackaacacattaaggtcaaaatag

SEQ ID NO: 497 - DNA, 1640 bp, Raphanus sativus
ggaaactaaaaatatcttcaaggggaaaagaagcaaataatggaaaccaaagccctaattttcacagttctcttcatcgttcttactctcagattcttgatcaggaaactcaagcgacaccctaacctccctccctctccgccatggtctttgccggtgatcggtcacctccgcctcctcaaaccgccgatccacagaactttcctctccatatctcagtctctaggcgacgctcccatcttctccctccgcttcggtaaccgactcgttttcgtgaactcctcacactccatcgccgaggagtgcttcaccaagaacgacgtcgtcctagcgaaccgtccgaacttcatcctcgccaattacgtcgcgtatgactacacaaccgtgatcgcagcttcctacggggaccactggaggaacctccgccgcatcggctccctcgagatattctccaaccatcggctcaacagcttcttgtctatccgtaaggacgagatccggcggttgatactacgtctctccagaaacttttcacaagaatttgcaaaggyggagatgaagtcaatgttatccgacttaacattcaacaacatcatcagaatggtggctggaaaacgttactatggagacggtgttgaggaggatccagaggctaaacaagtccggcagctcatcgcggatgtggtgactctagctggcgccgggaaygctgttgattacttaccgttcttgcgttgggtttcagattacgagaaacgtgtcaagaagctatcggctaggcttgacgagttcttgcaaaggttggtcgatgagaaacgggaagctaaagagaagggcaacacgatggtcgatcacttgctttctctgcaagaaacgcagcctggttacttcactgatcgcatcatcaaaggaaacatgctttccttgatactagcggggactgatacatcagcggtgacactagaatgggcattgtcgaacttgttaaaccatccggaggtattgaaaaaggcaagagatgagattgatagaaaagtcggtttagacaggcttatagacgaatcagacatctcgaatctgccttatctccaaaacatygtgtctgaaacgttacgcmtgtaccctgccgtccccatgctgcttcctcacgtggcctcggaagattgtaaggtaggtggatacgatatgcctagtgggacgatactgttgaccaacgcgtgggctatacacagagatcctcagctatgggaagatcccacgagtttcaagccagagaggttcgagaaagaaggagaatctcagaagmtaatggcgtttgggttgggaagacgggcgtgtcctggttccggactggctcrtcggctartaaacctgactcttgggtcattgattcagtgtttggaatgggagaggcttggagaagagaaagtggatatgagtgaaaggaaaggaggaactatgcctaaagccaagcctcttgaagccatgtgcagagcacgtgcctctgttggtaaaatcttccacgagggagcttgattttaggactttctgcaaggattcccaaaaaaaaacattaaataaatcgactgtaaatttccgacaatgttgatagttgttaacaagttacggtctgttcaacc

SEQ ID NO: 498 - DNA, 2191 bp, Arabidopsis thaliana
tttttgtctgctcaccaaatcaaaccaatttctcctgatagccaaagtttttgtccccaacaagaaactcatgcaacattcttcacccactagctaactaacgacttccattcttattaatctctctcaattcttcatttctgagattcatcgctctctcttctctttgtcacaatgaatttcaattcttcttacaatctcactttcaatgacgttttcttctcttcttcttcctccagtgaccctctggtttcacggaggctgtttctcttgagagatgttcagattcttgagctccttattgcaattttcgtctttgtcgcaatacatgccttgcgtcagaagaaataccaaggtcttcccgtgtggccgtttcttgggatgcttccttctctagcttttggcctcagaggaaacatatacgagtggctatccgatgttctatgtctccagaacggaactttccaattcagaggtccctggtttagcagcctcaacagcactatcacttgtgacccaagaaacgttgagcatctccttaagaaccggttttctgtcttccctaaaggttcttactttcgagacaatctccgagacctcctaggagatggaatattcaacgcggatgatgaaacttggcagaggcagaggaaaacagcgagcattgagtttcattcagccaaattcagacaattaaccactcaatctttgtttgagctcgtgcacaagaggctcttacctgttcttgagacatcggttaagagctcatctcctatcgatctacaagacgtcttgttgaggctaacgtttgataacgtatgtatgattgcttttggagtcgatccaggatgtctcggtccagatcaaccagtgattccttttgcgaaagcctttgaggatgcgactgaagctgcggttgtgagattcgtcatgcctacttgcgtgtggaagttcatgaggtatcttgatataggaacagagaagaagcttaaggaatcaataaagggtgtggatgatttcgctgatgaagttatcaggacgaggaagaaagaactgtctcttgagggcgaaactacaaaaagatcggatctcttaactgtgtttatgggtctgagagatgagaagggagagagtttttcagacaagtttcttcgtgatatctgtgtgaacttcatacttgctgggagagatacttcttctgtggctttgagctggtttttctggttgctagagaagaacccagaggtcgaagagaagatcatggtggagatgtgtaagattctgaggcagagagatgaccatggaaatgcagagaagagtgattatgaacctgtgtttggaccagaagagatcaagaagatggattatctacaagctgctttgtctgaagctcttagattgtatccttcagttcccgtggatcacaaagaggttcaagaagacgacgtatttcctgatggaactatgttgaagaagggagacaaagttatatacgcgatttacgcaatgggtcgtatggaagctatttggggaaaagactgtcttgagtttaggccagagaggtggctaagagacggacggttcatgagtgagtcggcctacaaattcacagcctttaacggtggtccacgcctttgtcttggcaaagattttgcctattatcagatgaaatctacggcggccgcaatagtttatcggtacaaggtgaaggtggtgaatggtcacaaggtggagccgaagttggcactcacaatgtacatgaaacatggtttgatggtgaacttgatcaataggagtgtctccgagatagatcaatactatgccaagtcttttgatgagggttatattaattagtgtttttaatgttttgaagatttgttaattgattaagttaatggtctaagaagattgtgtgcttacttttagttgatttgaatttttaaagtatgttttttgtgtccactttgttattagatgatgtgtacagtctatgggttatgtgtacgtggaaatgtggaggaagttgaatgggttatatatacttatatgtggaccgattatgggttgttgttaggaaattagttggtggggcttgtaatttgataataaattaattacttggaattttaattttagtttctatcagttttggttagcacttttggaattcaatttggaaacgaactttttt

SEQ ID NO: 499 - DNA, 1153 bp, Malus domestica
aacagagccaacccatccttcccaaatcgggaaacttccattcattctttagccttcccctctgcaattcctcctccaactctcatggaaggctcagccaatgaacgtcttgattttgggaagatgggttacggatgcaagcattacagaagaagatgccagattcgagctccgtgctgcaacgagatccatccgtgccgccattgtcacaacgaagccacgagcatgttgagcaacccctttgatcggcatgagcttgttcgctacgatgtgaaacaagttgtctgttcagtttgtgacacagagcagccggttgcaaaagtttgtacaaactgcggcatcagtatgggggaatacttctgtgacatttgcaaattctatgatgatgataccacgaaagaacagtttcattgtaatgattgtgggatctgcagaatcgggggtcgtgacaaattctttcactgcaagaaatgtgggtcttgctattcaattcgcttacgtgataatcacttgtgtgtggagaactccatgcgtcatcactgccctatttgttacgagtttctttttgactctctgaaagacactactgtaatgaaatgcgggcacacaatgcaccgcgaatgttacaatgaaatgatgcagcgtgacaaatattgttgtccgatatgctccaagtcagtgattgacatgtccagaacctggcagagaattgacgaggagatagaagcaaccgttatgcctgaggattaccggtataagaaggtatggatcctttgcaatgactgcaatgacactaccgaagtctacttccacataattgggcagaaatgcaaccactgcaactcatacaacacacgcacgattgcccctccagttcttcctcaatgatatcatcgagtctggtaggtgcagtgaaagcttgtaccattgcattatgattcaaatgattggaatgttgaaatgcgtccatcgaactttttcccggcaattgttcttattcttccaatttatgtggttaaaacccagttgatggtgactgtatgtgtcttgggttgatgtaaacattatactgtaattcaagggggtggtttatggaccagtgaaagattcgcccatgataaaaaccatgcccatgttgctttcaaaaaaaaaa

SEQ ID NO: 500 - DNA, 1252 bp, Malus domestica
ttttccattattttacagcttaatccttcaaaaaccagaaaatattgactattttaatggaaaggggacccctttactctacgtgatggctcgggctgttttcaaattgagccaacccatccttcccaaatcaggaaactttcattcattctttaagccttcccctctgcaattcctcctcttccaactctcatggaaggctcagccgatgaacgtctcgagtttgggaagatgggttacggatgcaagcattaccgaagaagatgccagattcgagctccgtgctgcaacgagatctatccttgtcgccattgtcacaacgaagccacgagtatgttgagcaacccctttgatcggcatgagctcgttcgctacgatgtgaaacaagttgtttgttcggtttgtgacacagagcagccggttgcacgagtttgtacaaactgcggcgtcagtatgggggaatatttctgtgacatttgcaaattctatgatgatgataccacgaaagaacaatttcattgtaatgattgtgggatctgcagaatcgggggtcgtgacaaattttttcactgcaagaaatgtgggtcttgctattcaaatggcttacgtgataatcacttgtgtgtggagaactccatgcggcatcactgccctatttgttacgagttcctttttgactcactgaaagaaactactgtaatgaaatgcgggcacacaatgcactgcgaatgttataatgaaatgatgaagcgtgacaaatattgttgtccgatatgctccaagtcggtgattgacatgtccaaaacctggaagagaatagacgaggagatagaagcaactgttatgcctgaggattaccggtataagaaggtatggatcctgtgcaatgactgcaacgacactaccgaagcctacttccacattattgggcagaaatgcaaccactgcaactcatacaacacacgcacgattgccccaccagttcttcctcaatgatatcatcgagtctggtagtcgcagtgaaagcttgtatcgttaatgggaacttgattgttatcctccaattgattctgtaccattactttgtgattcaaatgattgtaatgttgaaacgcgcccatcgaacgctttccaggccattcttcttcttcttccgatttatatggttaaaattcaaacccagtgtggtgactgttgatattgggttgagtaaacattatatgactgtattcaagggaatgatttatggacc

SEQ ID NO: 501 - DNA, 1117 bp, Brassica rapa
cgattccgataaaaccatcggattcaaaagcccattcattcccaatccaatccaaatccacttgttcttcgcataatatatagatagacaaatagagagagaaagagttacacctaccttttagctatctatctctatctctttctctctctatcagctttgtctcctcctgttctcatggaagcctcacccaatgatcgtcttcattttggcgtaatggctttcgggtgcgaccattacaataggagatgccaaatcagagctccatgttgcaacgaagtcttctcttgtcgtcattgtcacaacgagagcactagcacattgcgcaatatctatgaccgtcacgagcttgttcgtcaagatgttaaacaagtgatttgctctgtttgcgatacagagcagccggtagctcaagtatgcaccaactgtggtgtcaacatgggagaatacttttgcgatatctgcaagttctatgatgacaatactgcaaaggaacagttccattgtgatgactgtggaatttgcagagttggtgggcgtgagaacttcttccattgcaagaagtgtggatcttgttatgcgattggcctgcgcaacaaccatcgttgcgttgaggattcaatgcggcatcactgccccatttgttacgagtatctctttgactctcttaaagacacaacagtgatgaaatgtggacacacaatgcactttgaatgctatcatgagatgctcaagcgtgacaaattttgttgtccgatttgctcgaggtcagtgattgatatgtcaaaaacatggcagagaatggatgaagagattgaagccacttctatgccatcagattaccgcgacaagaaggttkggatactgtgcaacgactgtaacgacacaacagaagtaaactttcatataatcggtcagaaatgtggacattgtagatcttacaacaccagagccatcggacctcctgttcttcctcagtgactaaaccaaacatctttatcacttattaccgccaccagaaaagcaaccaagaacttcttgttgaaaaacaaagattgttgatcagtatgatcattattggtcacaaaagcaaagactcacatttgtcatcttcatg

SEQ ID NO: 502 - DNA, 1211 bp, Theobroma cacao
cggggcctaaaaaaaaaaacccaaaaaaaggggttttttttttcgaatactcatggagatggaagcctcttcagccaatgaacgccttcattttgggaagatgggttatgggtgccaacattatcggaggcgatgtgagattcgagctccttgttgcaacgaggttttctcttgtcgccattgccataacgaggctgcgagcatgttacggaacccctttgacaggcacgaccttgttcgacaagatgtgaaacaagttatttgctccgtttgtgacacagagcagccggttgctaaactttgttcaaattgtggcgtcaatatgggagaatatttctgtgaaatttgcaagttctttgatgatgataccgagaaagggcagtttcattgtcatgattgtgggatctgcagagttggtggcagagagaacttttttcactgcaagaagtgtgggtcttgctattccattgctctgcgagataatcattcgtgtgtggagaactcaatgcggcatcactgccccatatgctacgagtacctttttgattcgttgaaagataccaccgtgatgaaatgtggtcacacaatgcactgtgaatgttaccatgagatgataaagcgtgacaaatattgttgtcccatatgctccaagtcagtaattgatatgtctagaatctggaagaggatagatgaagagattgaagcaactgtaatgcctgaggactaccggtataagaaggtttggatcctatgtaacgactgcaatgacacwacagaagtttacttccacataatcggacagaaatgtagtcattgtaaatcatataatacccgcacgattgcccctccagttctccctcaatgacaagaccacggtcgaggaacatatacagtgaggtcaaaaggcatttaaggtttgcacgctaagcataaagcggaagaggaattcttcattggatgttcacatcgttggattgattttgaatcattatattatgattttatgactctagcgtttgttatgtcttttttttaaacttttgtcaggttattctttytcccatgtgtcggagttaaaaagaaagaactgtaaatggttctttcggttgatgtaaacgttacgtatactgcaactgaaagggaatactttttccccagttatgagactatgaaagtgtgccaagatgttaatgacacttataatttggaca

SEQ ID NO: 503 - DNA, 1307 bp, Brassica napus
ggagagagagaagataaagcgaaaagatccaaaggctttatttctttctctctgaaaaaataggaagattgaagaactttgtgttcaccttcttcgataaaaacaagaccgtggtggggtctcttattcattcctggccttgcgattccgataaaaccatcggattcaaaagcccattcattcccaatccaatccaaatccacttgttcttcgcataatatatagatagacagatagagagagaaagagttacacctaccttttagctatctatctctatctctttctctctctatcagctttgtctcctcctgttctcatggaagcctcacccaatgatcgtcttcattttggcgtaatggctttcgggtgcgaccattacaataggagatgccaaatcagagctccatgttgcaacgaagtcttcccttgtcgccattgtcacaacgagagcactagcacattgcgtaatatctctgaccgtcacgagcttgttcgtcaagatgttaaacaagtgatttgctccgtttgcgatacagagcagccggtagctcaagtttgcaccaactgtggtgtcaacatgggagaatacttttgcgatatctgcaagttctatgatgacaatactgcaaaggaacagttccattgtgatgactgtggcatttgcagagttggtgggcgtgagaacttcttccattgcaagaagtgtggatcttgttatgcgattggcctgcgcaacaaccatcgttgcgttgaggattcaatgcggcatcacygtcccatttgttacgagtatctctttgactctcttaaagacacaacagtgatgaaatgcggacacacaatgcactttgaatgctatcatgagatgctcaagcgtgacaaattttgttgtccgatttgctcgaggtcagtgattgatatgtccaaaacgtggcagagaatggatgaagagattgaagccacttctatgccatcagattaccgcgacaagaaggtttggatactatgcaacgactgtaacgacacaacagaagtaaacttccatataatcgggcaaaaatgtggacattgtagatcttacaacaccagagccatcggacctcctgttcttcctcagtgactaaaccaaacatctttatcacttattaccgccaccagacagaaagcaaccaagaacttcttgtcgcaaaacaaagattgttgatcaatatgatcattattggtcacaaaagcaagactcacatttgtcatcytcatgattmyakttrywgwsttsttatatatgawtatgktwgttaccattt

SEQ ID NO: 504 - DNA, 1214 bp, Brassica napus
aaaaaagcaaagtggatagagtcatagagagagagagagagagaccccctccatcggctctgtttcctcctgttctcatggaagattcacccaatgatcgccttcattttggcatcatgggtttcgggtgtgagcattacaggaggagatgccaaatcagagctccttgttgcaacgaagtcttcccttgtcgccattgtcataacgagaccactaccatccttcctttgttaaaacagagcactttgcggaatattttcgaccgtcatgagcttgttcgtcaagacgttaaacatgtgatttgttcggtttgcgatacagagcagccggtagctcaagtatgctccaactgtggtgtcaacatgggagaatacttttgcaatatctgcaagttctatgatgataatactgaaaaagaacagttccattgtgatgactgtggaatctgtagagttggtgggcgtgagaactttttccattgcaagaagtgtggatcttgttatgggattggtctgcgcaacaaccaccgctgcgtggaggattcaatgcgacatcactgtcccatttgttacgagtatctgtttgactcccttaaagaaactacagtgatgaaatgcggacacacaatgcactgtgattgctaccatgagatgctcaaacgtgacaaattttgttgtccgatttgctcgaggtcagtgattgatatgtccaaaacatggcagaggatggatgaagaggtcgaagccatttctatgccttcagattaccgtgacaagaaggtttggatactatgcaatgactgtaacgacacaacacaagtatacttccacataatcggacagaaatgtggacattgtagatcttacaacactagagcggtcgcacctcccgttcttcctcaatgacaaaacgaaagataattcacttattgccaccagcaagcgagcaagaacttcttgttgctataaaaaaaaacagtggcaaagattgatgatcggttatataacaaaaagggactaaagaaagattgattggtcacaaaagcagaacatacatttgtcttcttcatgattcgatttgtttgttgttcttatattgttatattgtcatgtataatatactctcgatccaggggaaaaccctacctggatttatatgttttcaaagatctgttgaaaactcaggcaatatattagttgcaatgtgtgttttct

SEQ ID NO: 505 - DNA, 810 bp, Ricinus communis
atggaagccactacccaatcttgcgggcgtcttgattttggcaagatgggctatggatgcgagcattacaggaggagatgcaggattcgagctccatgttgcaatgagatcttttggtgtcgccattgtcacaatgagtccgcgagcacattgaagaacctctgtgatcgtcacgagatcaatcgctttgatgtcaagcaagtgatatgttcagtttgtgacacagagcagccggttgctcaagtttgtacaaactgtggtgtcaatatgggggaatatttttgcggagtatgcaaattctttgatgatgatacagataaagggcagtttcattgtgatgattgtggaatctgtagagttggcggccgtgagaattattttcactgcagtaaatgtggttcatgctatgcaattagcctgcttggtaatcattcatgcgtggaaaattctatgcgccaccactgccccatatgttatgagtacttatttgactccctgaaagacactactgtaatgaaatgtgggcacaccatgcattttgaatgttacaatgagatgatagagcgagacaaatactgttgtcctatatgctccaaatcagtgattgacatgtccaaaacttggaagagaattgatgaggagatagaagcaactgtcatgcctgaagattaccgctacaagaaggtttggatcctgtgcaatgactgcaatgacacaacagaagtctacttccacataattggacagaaatgcagccactgcaaatcatacaacacccgcacaattgcacctccagttctacctcaatga

SEQ ID NO: 506 - DNA, 1282 bp, Citrus sinensis
ctataataaacacccatcttctctttgagggttggtacaaactagaaccaactaacctatcttcccaagtcaggaaagtctctttcttcttcgtttcgttggctttgccttgcttgctctgcagatccccatggaaggctcagctaatgaacgtattacttttgggaagatgggctatggatgcaagcattataggaggagatgcaagattcgagctccttgttgcaacgagatctttgattgtcgccattgtcacaatgaggcagcgagcatgttaagaaacccttacgatcggcacgaattagtgcgccaagatgtcaaacaagttatttgttctgtttgtgacaccgagcagccggttgctcaagtttgtactaactgtggcgtcaatatgggggaatatttctgtgacatctgcaaattctacgatgatgatattgagaagggccagtttcattgtgacgattgtgggatctgcagaatcggaggtcgtgagaattattttcactgcaagagatgtgggtcttgctattccactagtttgcgcaataatcatttgtgtatagagaattccatgcaccaccactgccccatttgttatgagtacctatttgactcactcaggaacactactgttatgaaatgtgggcacaccatgcattgtgaatgttaccatgagatgataaagcgtgataaatactgttgtcccatatgctccaagtctgtgattgacatgtccaggacctggaagagaatagatgaggagatagaagcaactgtgatgcctgaggactaccggcacaagaaggtttggatcctatgcaatgactgcaatgacacaactgaggtttacttccatataattgggcaaaaatgtagtcactgcaaatcctacaatacccgctcaattgcacctccagttctgcctcagtaacatggttgctgctttccacaaattgtattctgtcagccgcttcaaaagcttgcaccctgagcatatagcagaaagggagatttgtgattgggtagtaaaaaattgttagtctgatactaaattgatgcctgtataattgcatctatggttcgaaaggactccaagcatttgtattttgtgcatcagaaaactctacagatcattcttcctccgtctaatttatggagttcaaatcaaacccagctgatgggttctgaagttgatgtaaaacttatatacagtaattaagggaacaaatacaatcattgttatggactatatcatgtatcaacagttctgtcagctgaa

SEQ ID NO: 507 - DNA, 1266 bp, Gossypium hirsutum
ctaaccccccatctttcctaattgggaaactcctcccctctttctggayttatctggaaaataaaaaacccaaatagtaaatccaaatctttctttgttttcctcccccccaatactcatggagatggaagcctcttcagctaatcaacgcctccattttgggaagatgggatatggatgccaacattataggaggagatgcaagattcgagctccatgttgcaacgaggttttctcgtgtcgccattgccataacgaagctgtgaacctgttaagtaacccttttgacaggcacgagcttgttcgaaaagatgttaaacaagttatttgctcggtttgtgacacagagcagccggttgctcaactttgttcaaattgcggagtcaatatgggagaatacttctgtaaaatttgcaacttctttgatgatgatactgagaaagggcagttccattgtgatgattgtgggatctgcagagttggtggccgagagaatttttttcactgcaagaagtgtgggtcttgctactctgttgccttgcgagggaatcatacttgtgtggagaattcgatgcagcatcactgccccatatgttacgagtacctcttcgattcgttgaaagatacgactgtgatgaaatgcggtcacacgatgcactatgaatgttaccatgagatgctaaagcgtgacaaatattgctgtcccatatgctcaaagtcggtgatcgatatgtcccgagcctggaagaggatggatgaagagattgaagcgaccctaatgccggaggattaccgatataagaaggtttggattctatgcaatgactgtgacgacactaccgaggtttacttccacataatcggacagaaatgcagtcactgtagatcttacaacacccggacgatcgccccaccggaactccctcagtgatgagatcatgatcgaagaaccgaagccggtgagctcctgacttctaaaggtctgctcgttaactgtaaaagcggagatgaattcttctaatttgcatatcatgtctcgatcatctcgatccatcatcgtcattggatttgattatatgattcagtgtattattattcaaatgattgtgccatttttatgtcttcyctcataaacatttctcaggttatsggttcyccatttcgggtgtgaatggttctatggttgatgtaaacgctatatgataatttgtaataataacaracattagagaatttgatggtaatatatccattttttctctttgt

SEQ ID NO: 508 - DNA, 1349 bp, Gossypium hirsutum
gaaaaaaacgagtgcccctttgaaggcgggggttggcattcttttctcttcatttaagaatccacgacaatccaagaaaatttagatcccatcttcccaattcaggaaaccccctcttctttctgggtttcctctggataatccgagaagaaaagaacaaaatttgtcttccaattctcctggagatggaggcctcttcagccaatgaacgccttcattttgggaagatgggatatggatgccaacattataggaggagatgtaagattcgagctccctgttgcaacgaggttttttggtgtcgccattgccacaatgaggcttcgagcatgttaaagaaccccatggacaggcacgagattgttcgccaagacgttaaacaagttatttgttcggtttgtgacacagagcagccggtcgctcaactttgttcaaattgtggtgtcaacatgggagaatatttctgtgcaatttgcatgttctttgatgatgataccgagaaggagcactttcattgccatgattgtgggatctgcagagtcggaggtcgtgataacttttttcattgcaaaaagtgcgggtcttgctatgccattgcgttgcgagataatcatttgtgcgtggagaactcgatgcggcatcattgccccatatgttatgagtacctattcgattcgttgaaagatacgactgtgatgaaatgcggtcacacgatgcactgcgaatgttacgatgagatgataaagcgaaacaaatattgttgtcctatatgctcgaagtcagtgatcgatatgtctagaacctggaagaggatagacgaagagattgaagcaactgtaatgccagaggactaccggcacaagaaggtttggatcctatgcaatgactgcaatgacactacagaagtttacttccacataatagggcagaaatgcagtcattgtaaatcatataacacacgcacaatcgcccctcccatacttcctcactgagaagatcacgagcgaggaaccaaagaagtgagctcgaggcatttaaggtttgggcctctactcattaacgggaagacaaattcttgattacatgttacaatcatttaaacttgtgttcatcattggattgattactgtaccccaatagtatatgattcatatggcactggcatttttatatcttacgaatttctttctcccatttcggagttttagaaaaagaawgcaakggtsgattgtttcattgawaatkggskgaaccttctttttykgctcattttttttakgtcayccttccattatttyttttrgaacatttwtcatccagkgaaagttatatttgaactcaaaaaaaag

SEQ ID NO: 509 - DNA, 1210 bp, Vigna unguiculata
gcagaaacccccctctcagccttctcttcaccctctcttttccaaaactcatggaacgttctgtccttgaacgtcttgattttgggaagatgggatacgggtgcaagcattacagaagaagatgcaggattcgagctccatgttgcaatgagctctactcttgccgtcattgtcataacgacgcaacgagcatgctgagcaaacctctcgatcgccacgaactcgttcgccaggatgttgaacatgttgtttgttcagtttgcgatacagagcagccagttgcccaagtttgtacgaactgcggtgtcagaatgggagaatatttttgcagcatctgcaaattcttcgatgatgagaccgggaaagaacattttcattgtgatgattgtgggatatgcagagttggtggtcgtgagaattttttccactgcaagaagtgtgggtcttgctattcaaatggtctgcgggataatcatttgtgtgtggaaaactccatgaggcatcattgtcccatttgttatgagtacctttttgactcattgaaagacactgctgttatgaaatgtggccacacaatgcattctgaatgttaccacgagatgataaagcgtgaccagtattgttgtcccatatgctccaagtctgtaattgacatgtctaggacatggaagagaatcgatgaagagattgaagcaactgtcatgcctgaggactatcagaacagaaaggtttggatactctgtaatgactgcaacgacacaactgaagtttacttccacatcattgggcataaatgtggtcactgcaactcatacaatactcgtgcaatagctcctcctgttcttcctcaatgactagattcttttgattttggagacagatcttttgatttatggctcaattattgtagagcctcatttgattcatcatcatcatcatcaagattaatgatgtattgtggcctaaattttcttggtctagtggtaatgttatgagccactaattggtctgatacaaacatgtgtatatagggcaatgtgtttgaacatcccgagttgctagtaattgtgcttgccagtgatgtattgaagtaggggaattgattgtttttgtgttattgaactgaatttattcatcacaatattgatagtaagcgtgcttgtcttgccattawwraawmwaawcmwmamaaskmaawawggtttcttca

SEQ ID NO: 510 - DNA, 1196 bp, Vitis vinifera
cctcatggaaggctctgctgatgaacgtcttgattttgggaagatgggttttgggtgcaagcattacagaagaagatgcagaattcgtgctccctgctgcaacgagatctttccttgccgccattgtcacaacgaggccacgagcatgttgagaaacccctttgatcggcacgaactagttcggcatgatgttaaacaagtgatatgtgcagtttgtgacacagagcagcctgttgctcaagtttgtacaaattgtggcgtcaatatgggggaatatttctgtgaagtgtgcaaattctatgatgatgatactacgaaagggcagtttcactgtgatgactgtgggatctgtagagttggaggtcgtgataaattctttcactgcaagaagtgtggatgttgctattcggtgggtcttcgtgataatcattcatgtgtcgagaactccatgcggcatcactgtcccatatgttatgagtatctttttgactcactcaaggataccacagtcatggtttgtggacacacaatgcattgtgaatgttacaatgagatggtaagccatgacaaatactgttgtccaatatgctccaagtctgtaagagatatgactagaacctggaagagaattgatgaagagattgaagcaactatcatgcctgaggattaccaacacaagaaggtttggatcctctgcaatgactgcaacgacactactgaagttttctaccacataattgggcagaaatgcagccactgcaaatcatacaacactcgcatagttgctcctccagttctaccacaatgactagattaagctttcaggacagtgtccaaccaagtgggcacatagaaagctttttccccaggctaaaaagcggagtgggtttctcttggtgggtcaaaccatttgtcagctgttttccaattaatgattttgagtaccattacataatttgtatgtgtgcctcataaatctttatcaaattattcttccccaaacatatggatttaaaatatggttccacaaactaagtggattaatgtatacattatatagagtgtaatgttagtttaggggaacaacagattcctgatatagactacctacatgaattgtggtcatggtgtttgacaattatgagtcttcaacaacatcgtgtcctcgtgttttacatgtacccacatattccttt

SEQ ID NO: 511 - DNA, 1261 bp, Ipomoea nil
ggtccacttgacagggatgccacttttctctcgataaggaactttgggttttgtgcagtaatcccattcttcccctccaaatccaaatctcgtcttccttcccttctcctccagcgcctaccctcctttctccgtggaagtgtggtgtaggtgccagcactttaatgcacagaatggaaggatcatcagatgatcggcttggatttgggaagatgggatatgggtgccaacattataggagaaggtgcaagattagagcatgttgctgcaatgaagtctatggctgtcgtcactgtcataatgaagaagcgagcatgttgcgcaatccttttgataggcatgagctgaaccggcatgaggtcaagcaagtgatttgttccgtttgtgatacagagcagccagtggctcaagtttgcacaaactgcggtgtcaaaatgggagaatacttttgtaaaatttgtaatttctttgatgatgatatcgagaaagggcagtttcattgtgatgattgtggaatatgcagggttggaggtcgggacaacttctttcattgcaagaaatgtggctcttgttatgcaattagtctgcgtaacaatcactcttgtgtggagaactccatgcggcatcactgccccatttgttatgagtacctcttcgattccctgaaagacacaacagttatgaaatgtgggcacacgatgcattatgagtgtttttacgagatgataaagcgtgataagttctgctgcccaatatgttcaaagtcaatcatcgacatgtccagcatttggaaagaaatggatgaagagatagaacagactaccatgcctgatgattacagagacagaaaggtttggattctatgcaatgactgcaacgacaccacagaagtattgttccacataatcgggcagaaatgtcgccactgtcaatcatacaatactcgcacaattgctccccccgtgctccccaatccctagcagcagcactgctctgcttgtttgatcggctatgaattttgacagctttggacgccgttgccatggatgtaaacaaaacccagaaagttaaagaaggcttctttgttgggattttaattgaatccccattgcatcacagcaattcatcttgaactttgcagtgattcgtgctgcagaagcgtttgtaacataattttttttgccaatcattcaaaacaaatttcaactcactcccttgtgctagaaaagtggaatgttatgaaataaaactataaaaaata

SEQ ID NO: 512 - DNA, 925 bp, Lactuca sativa
gatgcatcaaatatatatatattctcctcgatgcttgtgtccaaagatcatataacacccccattctttccgaattaggaaacttttactgcatctccatctccatctccctcaacctccatggcaggccccaacgacgaacgcttggattttgggaagatgggttacggatgcaagcattatcgaagaagatgtatgattcgagctccttgttgtaacgagatattcgactgtcgtcattgtcacaacgaggctacgaatatgttgaaaaatccctacgatcgccatgaacttattcgatccgatgtgaaacaagtgatttgttcagtttgcgacacagagcaacctgttgctcgttcctgcacaaattgtggcgtcaatatgggggaatacttttgtgaattgtgcaaattctacgatgatgatattgacaagggtttgttccactgtgacgattgtggcatctgcagagttggtggacgtgagaacttcttccattgcaaaaaatgtggaacttgctattctattggtttacgtgataaccatttatgtgtcgaaaattctatgcgacatcattgtcccatatgttatgagtatttattcgactcgatgaaagacactgcagttatgaaatgtggacacacaatgcatcgtgattgttacaacgagatgataaaacgagataaattctgctgtccaatatgcgccaaatccattatggacatgtctgcaacatggaagatgatcgatgaagagatcgaagctactctaatgcctgatgattacagrcacaagaaggtttggatactatgtaacgactgcaatgacactacrgaagttttctttcacataattggacagaaatgccgccattgcagatcgtataatacacggacgattgcgccccctgttttacacaagaatg

SEQ ID NO: 513 - DNA, 1508 bp, Medicago truncatula
cggccggggattgttgygttgtggatcaagccaaaacgattctcaacaccaaaacaaaatctcctctcacccttccttccctctcccatccaaaactcatggaagcctctgccattgaacgtcttgattttgggaagatgggatatgggtgtaagcattataggagaagatgcaggattcgtgctccttgttgcaatgaggtttactcttgccgtcattgtcataacgaggcaacgagcatgctgaaaaacccttttgatcaccacgaacttgttcgtaatgatgttgaacaagttgtttgttcggtttgtgacacagagcaaccagttgctcaagtttgcactaactgtggtgtcagaatgggagaatattactgtgacctctgcaaattctttgatgatgatacggggaaacagcagtttcattgcgaggattgtgggatctgcagagttggtgggagtgagaattatttccattgcaagaagtgtgggtcttgctactcagttgctctgcgtgataatcatttatgtgtggagaactccatgaggcatcattgtccaatttgttacgagtacctgtttgactcattgaaagatacaactgttatgaaatgtggccacacaatgcattgtgaatgttaccatgagatgataaagcgtgacaagtactgttgtccaatatgttccaagtcggtgattgacatgtctactgcatggaagagaatcgatgaagagatcgaagcaactgtcatgcctgatgattatcggaatagaaaggtttggatactttgtaatgactgcaacgatacaaccgaagtttccttccacattattgggcataaatgcggtcactgcagttcatataacactcgtgctattgctcctcctgttcttccacaataaccgaattctcgcagttcacgaagcatgtctttgccctatgacccaattgttgtagagactcatttaattcatcctcaagattagtggtgtattgtgtatgccctgaaacttttcataggttattcttcctccaatgtatggagtggacaagttggagctggtatttgagtcattagactattataaacatctgtatactaaatacaacatgggggaaaaagctttaccctgcatgagctgatgataattgtgttgtgtcgtctactgttgtattggatagtggaggccatatgctgattgatattgtaggccttcatagaaatcctttgtgattgatttgttatgttgcatttttactatcatatagaaaaggaatttggatccactgcagtcaacatttacctcataaatgcattcagggacatctgtgaccgaccgtccgatcctgaccagatggttcaaagaaatgcagattttaattattagtttattattcaagatactgagctcgaatcttggaccatccgatcttgaatgcgaggaatgttgattacaggagacccgggtccatatagaagcgtgatctctgacactcatttcaacact

SEQ ID NO: 514 - DNA, 1321 bp, Prunus persica
tattttaatgaggggagtaatgtaaaagtgacccatttacgcgatggctgtctctgtctaattgagggatcgagacaaacagagccaagccaacaaccaacccatccttcccaaatcgggaaacttcctttcgttcttttagccttctctgcaaatctcctctccagctcccatgggaggctcagggaatgaacgtctcgattttggaaaaatgggttacggatgcaagcattatagaagaagatgccagattcgagctccgtgctgcaacgagatctatccatgtcgtcattgtcacaacgaagccacgagcatgttgagcaacccttttgatcggcatgagctcgtccgctacgatgttaaacaagttgtttgttcagtttgtgacacagagcagccggttgcacgagtctgtacaaactgcggcgtcagtatgggggaatatttctgtgaaatttgcaaattctacgatgatgatactgataaagggcaatttcattgtaatgattgtgggatctgcagaattggcggtcgtgagaatttctatcactgcaagaagtgtgggtcttgctattcagttggcctacgcgataatcacttgtgtgtggagaactccatgcggcaccactgccccatttgttatgagttccttttcgactcgctgaaagacactactgtaatgaaatgtggtcacacaatgcactgtgaatgttacaatgaaatgatgaagcgtgacaaatactgttgtccaatatgctccaagtcagtgattgacatgtccagaacctggaggagaatagatgaggagatagaagcaacagcgatgcctgaggattaccggtacaagaaggtatggatcctgtgcaatgattgcaatgacactaccgaagtttacttccacattattgggcagaaatgcaaccactgcaaatcatacaatacccgcacaattgcccccccagttcttcctcaatgaccagacattcagacattggttcccatcccaggaatatatccagtctggtaggcgcagtgaaaagcttgcaccgttaatgaacaacgtaaatggggattcggtttttatcctctcaattggttctgtaccattgcattatgattcaaatgattgtaatgttgtatgcgtccatcgaactttttccaggctattgttcttccgccaatttatgtggaacccaggtgatcagtcttgggtttatataaacattatatatactgcaattcaagggaatggtattatggaccaatgaaagatatgccagatgataataaggatcatctgtcattatatatactttgaacc

SEQ ID NO: 515 - DNA, 1247 bp, Populus trichocarpa
ggaaagtcctttgtgcacccctggtctttccttcctctttctctctacttcttcatttttttatcctctcatccattcctccataactcatggaatccactcctgtttccaatgaacgtcttgattttggaaagatgggttacggatgccaacactacaggagaaggtgccagattcgggctccatgttgcaacgagattttcacttgtcgccactgtcacaacgaggccacgaatatgttgaagaacttctgcgatcgtcatgagctcaatcgatatgatgtcaaacaagttatatgtgcagtttgtgacacagaacagccagttgctcaagtttgcacgaactgtggcgtaaatatgggggaatatttctgcgaaatttgcaaattctttgatgatgataccgcaaaaggacagttccattgtgatgattgtgggatctgtagagttggtggtcgcgaaaattattttcactgcaagaagtgtggttcttgctatgcaacatctcttcttgataatcattcgtgtgtggagaactctatgcgtcatcattgccccatatgttatgagtatttatttgattcactaaaagaaactactgtaatgaaatgcgggcacactatgcatggtgaatgctacgatgagatgataaagcgtgacaaatactgctgtcccatatgctccaagtctataattgacatgtctaaaacctgggagagaatagatgaggagatagaagcaactgtcatgcctgaggattacagccacaggaaggtctggatcctatgtaacgactgcaacgacactaccgaagtttatttccacataatcgggcagaaatgcagccactgcaaatcatacaatacccgaacaattgcacctccagttctacctcaatgattaggtttggcaaaatgcatccagcctcgtaggagcattggttgctttcatgtgaaccatgctggatatttttacgtgtattcgaccattttgaatgctggcaaattgtttactaattctgttctattgcaaaacgattcagaagtggcatctgggtgcctcagaaacttctctcaggttattcttcctccaatattgggagtcggaacccagttattgagtctctgggttcatgtaaacttctctttatacacaaacaaaccaaaacattggttcctgttatgtactcctcctgattgtgtcatctcgttgaatcttctggtattgtataatactagccatttgacc

SEQ ID NO: 516 - DNA, 1312 bp, Prunus persica
gaggggagtaatgtaaaagtgacccatttacgcgatggctgtctctgtctaattgagggatcgagacaaacagagccaagccaacaaccaacccatccttcccaaatcgggaaacttcctttcgttcttttagccttctctgcaaatctcctctccagctcccatgggaggctcagggaatgaacgtctcgattttggaaaaatgggttacggatgcaagcattatagaagaagatgccagattcgagctccgtgctgcaacgagatctatccatgtcgtcattgtcacaacgaagccacgagcatgttgagcaacccttttgatcggcatgagctcgtccgctacgatgttaaacaagttgtttgttcagtttgtgacacagagcagccggttgcacgagtctgtacaaactgcggcgtcagtatgggggaatatttctgtgaaatttgcaaattctacgatgatgatactgataaagggcaatttcattgtaatgattgtgggatctgcagaattggcggtcgtgagaatttctatcactgcaagaagtgtgggtcttgctattcagttggcctacgcgataatcacttgtgtgtggagaactccatgcggcaccactgccccatttgttatgagttccttttcgactcgctgaaagacactactgtaatgaaatgtggtcacacaatgcactgtgaatgttacaatgaaatgatgaagcgtgacaaatactgttgtccaatatgctccaagtcagtgattgacatgtccagaacctggaggagaatagatgaggagatagaagcaacagcgatgcctgaggattaccggtacaagaaggtatggatcctgtgcaatgattgcaatgacactaccgaagtttacttccacattattgggcagaaatgcaaccactgcaaatcatacaatacccgcacaattgcccccccagttcttcctcaatgaccagacattcagacattggttcccatcccaggaatatatccagtctggtaggcgcagtgaaaagcttgcaccgttaatgaacaacgtaaatggggattcggtttttatcctctcaattggttctgtaccattgcattatgattcaaatgattgtaatgttgtatgcgtccatcgaactttttccaggctattgttcttccgccaatttatgtggaacccaggtgatcagtcttgggtttatataaacattatatatactgcaattcaagggaatggtattatggaccaatgaaagatatgccagatgataataaggatcatctgtcattatatatactttgaacc

SEQ ID NO: 517 - DNA, 1158 bp, Raphanus sativus
tctctcctcctgttctcatggaagcmtcacccaatgatcgacttcrttttggcaagatgggtttcgggtgtcagyattacaggaggagrtgccagatcagagctccttgttgcaacgaagtcttcgattgtcgccattgccataacgagttcactagcactctgcgcaatatttacgaccgtcatgagcttgttcgtcaagacgttaaacaagtgatttgttctgtttgcgatacagagcaaccggtagctcaaatatgctccaactgtggtgtcaacatgggagaatacttttgcaatatctgcaagttctatgatgataatactgagaaacaacagttccattgtgatgactgtggaatctgcagagttggtggacgtgagaacttcttccattgcaagaaatgtggatcttgttatgcgactggtctgcgcaacaaccatcgctgcgttgaggattcaatgcgacatcactgccccatttgttacgagtatctctttgactctcttaaagaaacaacagtgatgaaatgtggacacactatgcactgtgaatgctaccatgagatgatcaagcgtgacaaattttgctgtcctatttgctcgaggtcagtgattgatatgtcaaaaacatggcagagaatggatgaagagattgaagccacttctatgccttcagattaccgcgacaagaaggtgtggatactatgcaacgactgtaacgacacaacagaagtttatttccacataataggacagaaatgtggacactgtagatcttacaacaccagagccgtcgcacctcctgttcttcctcaatgacacatcaccaaaagatctttcacttgtttccatctaccagaaagtaagcatgaactttttgttgcaaaaaactttcttgatgatcggtttatagcaagaaaaagattgatgatcaatatgatcattggtcacataaggaaaaacacatatctgtctacttcgtgattctatttgttgttggtttttatatggtcaaaccatttatgtttgggtgtggtaaagccaggattatgtataatatactctaaaaatattcttgatccaggaaaaatacctgtgatatgaaaggtgtgttttgtattgttatttcattcaaaaaatttttcagattccccca

SEQ ID NO: 518 - DNA, 1405 bp, Raphanus sativus
ggaggagagagagaagataaagcgaaaagatccaaagctttatttatttctctctttcatattttttttcctgcaaaataggaagattgaagaacatttgtgttcatcttcttcgataaaaacaagaccttggtgtgggtggggtttcttattcattcctggccttgtgattccgataaaactaaaatcggattcaaaagcccaattcaatccaaatccaaatccacttgttcttcgcataataaatatatagattgatagatagaaagagagagaaagagttacctaccttttagccatctatctctttctctctctctatcgagctttgtctcctcctcctgttctcatggaagcctcacccaatgatcgccttcatttcggcataatgggtttcgggtgcgaccattacaataggagatgccaaatcagagctccatgttgcaacgaagtcttcccttgtcgccattgtcacaacgagagcactagcacattgcgtaatatctatgaccgtcacgagcttgttcgtcaagatgttaaacaagtgatttgctctgtttgcgatacagagcagccggtagctaaagtttgcaccaactgtggtgtcaacatgggagaatacttctgcgatatctgcaagttctatgatgacaatactgaaaaagaacagttccattgtgatgactgtggaatttgcagagttggtgggcgtgagaacttctttcattgcaagaagtgtggttcttgttatgcgattgggctgcgcaacaaccatcgctgcgttgaggattcaatgcggcatcactgtcccatttgttacgagtatctctttgactctcttaaagacacaacagtgatgaaatgcggacacacaatgcactgtgaatgctatcaggagatgctcaagcgtgacaaattttgctgtccgatttgctcgaggtcagtgattgatatgtcaaaaacatggcagagaatggatgaagagattgaagctacttctatgccttcagattaccgcgacaagaaggtttggatactgtgcaacgactgtaacgacacaacagaggtatacttccatataatcggtcagaaatgtggacactgtagatcttacaacaccagagccgtcgcacctcctgtccttcctcaatgaaaacaccaaacatctttcatgtattgccaccagaaagcaaccaaagaaaaaaaactctgatcaatgattcaatatgatcattggttcacaaaagcaagactcacatttgtcttcttcatgattctatttgttgttgttcttatatgattatgtttattaccatttatatttatgtgtgagaaaagccaggataatgtataatatatatattcttgatccaggaaaaaattacctgtgattatatgtttcata

SEQ ID NO: 519 - DNA, 1362 bp, Glycine max
aacaatggcttgctcctcctccttcctctttctttgtcaatatcaacaccaacagaatcttcccatttcaggaaactcttctctcagccttccttcccggcctttcttttccaaaactcatggaaggttctgtccttgaacgtcttgattttgggaagatgggatacgggtgcaagcattatagaagaagatgcaggattcgagctccatgttgcaatgagctctactcttgccgtcattgtcataacgaggcaacgagcatgctgagcaacccttttgatcgccacgaactcgttcgccaggatgttgaacatgttgtttgttcagtttgtgacacagagcagccagttgctcaagtttgcacaaactgtggtgtcagaatgggagaatatttctgcagcatctgcaaattcttcgatgatgataccgggaaacaacagtttcattgtgatgattgtgggatttgtagaattggtggtcgagagaattatttccactgcaataagtgtgggtcttgctattcaactagtctgcgtgataatcatatgtgtgtggagaattccatgaggcatcattgccccatttgttatgagtacctttttgactcattgaaagacactgctgttatgaaatgtggtcacacaatgcatagtgaatgttacctagagatgctaaagcgtgacaagtattgttgtcccatatgctcaaagtcggtgatggacatgtctagggcatggaagagaattgatgaagagattgaagcaactgtcatgcctgatgattatcggtacagaaaggtttggatactctgtaatgactgtaatgacacaactgaagtttacttccatgttcttgggcaaaaatgtggtcactgcagttcatataatactcgcgctatagctccccctgttcttcctcaatgaccagatacttatggttttggagacaaatttttccgggcagtaaattaaaattatgactcatttattgtagagccttatttgattcatcatcaagattaatgatgtactatgccctgaaacttatcttgggttattcttcctccaccatttggagtgggactggtggttttgttatgaggcactaattgggctgatataaacatgggtatactgtaatatagagaatgtggtttagtcagcatgagctactagtaattgtgtttactagtgatgtattgatgttggaggatggattggcttgtctttgccattattgaatttaatcaacacaactcaatgatttcttccctgcataaatcaatcatatgctattacctttatagtgattgatttgttatgattcaacgtacatattgtgttatacaattccatttatcta

SEQ ID NO: 520 - DNA, 1343 bp, Glycine max
gtccttttaagtctttctctttttgggatcacgccacatatcttcccaaatcaggaaactctttctcttcttccgtttcctagtctcacacccaaacctcatggaaggctctgtcaacgaacgtcttgattttgggaagatgggatatgggtgcaatcattaccggagaagatgcaggattcgtgctccctgctgcaacgagatctactcatgccgtcactgtcataacgacgctgcgagcttgttgaagaatccctttgatcgccacgagctcgttcgccaagatgttaaacaagttgtttgttcagtttgtgacactgagcaacctgttgctcaagtttgcacaaactgtggcgtcaaaatgggagaatacttctgcaacatctgcaaattcttcgatgatgatgttgagaaagaacaatttcactgtgatgattgtgggatctgcagggttggtggtcgagataattttttccactgcaagaagtgtggatcttgttatgcaattggtctgcgtgataatcatttgtgtgtggagaactccatgcggcatcactgtcccatttgttacgagtacctttttgattcattgaaagacaccattgttatgaaatgtggtcacacaatgcaccatgaatgttacgtagagatgataaaaaatgacaaatattgttgtcccatatgctccaagtcagtgattgacatgtctaagacgtggaagagaattgatgaagagattgaagcaactgtcatgcctgaagattatcgaaacaggaaggtttggatactatgtaatgactgcaatgacacaacagaagtttacttccacattcttggccaaaaatgtggtcactgcagatcatataatactcgtgcagttgcgcctccagttcttccccaatgaccagattcttgggttcaagaagggaaaactgtcagcagaaaattaaagttagcaccctgttattattatagagggctattgaattaattgagcatcaaaagtgattggtgtattgtgtcctagatagttttcttaggttattcttcctccaacatatggagtgggattgttgtctcttggttattgggctggtatgaacatctttatactgtaacagagggaaaacatttttcccggtcatgaattgctggtaatagtgatgtatttgatactgggtgattgattgcattgtcagccattgtggttctctataatttggtcgggattatttgatccttgtagtttttctcgcacattggaataaactgtgatcgttagttttgatcattctattcccagccattattttacaaaagtggaaatagtcatctttttgtgg

SEQ ID NO: 521 - DNA, 1531 bp, Glycine max
gacttggttttgtagatctctggtatcccaagtgggcgatcctacagcgatattctcttctctcctcctatgcgccttatctcatcccaagtggtcattctctttttctctatcactgctgcctgcaaacaaaagatatttatattgcattaaaaagatgaaaaaaaagggcaagagtgtgtggtccttttaagttgaacatgatggaatggccgtctttctcttttgggtatcttcccaaatcaggaaacactttctcatcttccctttcccagtttcacaccctacctcatggaaggctctgtcaacgaacgtcttcattttgggaagattggatatggatgcaatcattacaggagaagatgcaggattcgtgctccctgctgcaacgagatctactcatgccgtcactgtcataacgaggccgcgagcttgttgaagaatccctttgatcgccacgagctcgttcgccaagatgttaaacaagttatttgttcagtttgtgacactgagcaacctgttgctcaagtttgcacaaactgtggcgtcaaaatgggagaatatttctgcaacatctgcaaattcttcgatgatgatgttgagaaagaacagtttcactgtgatgattgtgggatctgcagggttggtggtcgagataattttttccactgcaagaagtgcgggtcttgttatgcagttggtctgcatgataatcatttatgtgtggagaactccatgaggcatcactgtcccatttgttacgagtacctttttgattcattgaaagatgtcattgttatgaaatgtggtcacacaatgcaccatgaatgttacctggagatgataaaaaatgacaaatattgttgtcccatatgctccaagtcagtgattgacatgtctaagacatggaagagaattgatgaagagattgaagcaaccgtcatgcctcaagattatcgaaacaggaaggtttggatactatgtaatgactgcaatgacacaacagaagtttacttccacattcttggccaaaaatgtggtcactgcagatcatataatacccgcacagttgcacctccagttcttccccaatgaccagatctcttgggttcaagaagggaacactgtcagcagaaagttaaagttagcaccctgttattactatggagggttattgaattaattgagcatcaaaagtgattggtgtattgtgtcctagatagttttcttaggttattcttcctccaacatatggagtgggattgttgtctcttggttatttattgggcaggtataaacatctttatactgtaatagagggaaaacatttttcccgtcatgaattgctggtaatagtgatgcattgatacttgatgattgattgcattgtcggccatagtggttttctataatttggttgatgttatttgatccttgtagtctgtctcgcacattgggataaactgtgattgttagttttgatcattctattctcaattacaaatgtagaaatagtcgtcttttgaggtta

SEQ ID NO: 522 - DNA, 1010 bp, Fragaria vesca
gatgatgatggggctggctgtctctttctaattgagggggattcagacaaacagagaagccaaccccatccttcccaaatcgggaaacttctccttctttgctttgtctgcgattcccttccctctcttctcctactctcatggaagcctcaggcaatgaacgtcgaagttttgggaagatgggttacggatgcaagcattacagaaggagatgccggattcgagctccgtgctgcaacgagatctacccatgtcgccattgccacaacgaggccacgagcatgttgagcaacccctttgatcggcatgagctcgttcgacacgatgttaaacaagttatttgttctgtctgtgacacagagcagccggtggctcgagattgcactaactgcggcgtcagtatgggggaatatttctgtgatatttgcaagttctatgatgatgatactgagaaagggcaatttcactgtgatgattgtgggatctgcagaatcggtggccgtgaaaatttttatcactgcaaaaagtgtgggtcttgctattcgatcagcttgcttgataaccacctgtgtgtagagaactccatgcggcaccactgccccatttgctacgagttcctttttgactctctgaaagacaccactgtaatgaaatgtgggcacacgatgcattgtgaatgttacaacgaaatgataaagcgggacaaatattgttgtccaatatgctccaagtccgtgattgacatgtctagaacttggaagagaatcgatgaagagatcgaagcaaccgttatgcccgaggattatcggaataaaaaggtttggatcctctgcaatgactgcaatgacacaaccgaagttttcttccacattattggccagaaatgcaaccactgcaaatcatacaacactcgcacaattgcccctccagttcttcctcaatgatcagagatgttagccacaaatatgtccagtccggtagcgcagtgaaagctgtaccctcaatgtgcc

SEQ ID NO: 523 - DNA, 1457 bp, Thellungiella halophila
ggacaacattcaaaaggagagagagaaagagagagaataaaagtaaaaaagatccaagcttttactttctttctctctttcatttctgtaaaacggaagattgaataatttgtgggtttatcttcttctataaaaacaaggcgtggggtctgatttcattcctggcctagcgattccgataaaactatcggcttcgaagcccattcaatcaatctaaatccttttctttacaaaatatatatatatagagagagaagagtttaccttttccaatctctatctctctctctccttctctctctcactatcggcttttctcctcctgttatcatggaagcttcacccaatgatcgccttcattttggcaagatgggtttcgggtgtgagcattacaggaggagatgcctaatcagagctccatgttgcaacgaagtcttcgcttgtcgccattgtcacaacgagagcactagcacattgcgtaatatctatgaccgtcacgagcttgttcgtcaagacgttaaacaagtaatttgtcttgtttgcgatacagagcagccggtagctcaagtttgctccaactgtggtgtcaaaatgggagaatatttctgcaatatctgcaaattctatgatgacaatactgaaaaacaacagttccactgtgatgactgtgggatttgcagaattggtggccgtgagaacttcttccattgcaagaaatgtggatcatgttatgcgatcggtctgcgtaacaaccatcggtgcgttgagaattcaatgcggcatcactgtcccatctgttacgagtacctatttgactctctaaaggacacaacagtgatgaaatgcggacacacgatgcactgtgaatgctaccacgagatgattaagcgtgacaagttttgttgtccgatttgctcgaggtctgtgattgatatgtcaaaaacatggctgagaatggatgaagagatcgaagccactgctatgccttcagattaccgcgacaagaaggtttggatactatrcaacgactgtaacgacacaacagaagtgtacttccacataatcggacagaaatgtggacattgcagatcttacaacacgagagcgattggacctcctgttcttcctcaatgacagaaccaagatctctcatgtattgccaccagaaagtaagcaagaacattttttgttgcagaaaaatttggtgctgatgatcggttataacataaagaaaagaaaaaaaaaaaaaacagaaaagattgatgatcaatatgtattggtcacaaaagtaaaacacacatttgtcttcctcatgatttgatttgttgttgttcttatatggttatattttaccatctatgcttgggtgtttggaaagtgaggattatgtgtaatactatctatgtattcttgacccaggaaaattacctggatataatgttttcagagacttgtcg

SEQ ID NO: 524 - protein, 142 aa, Raphanus sativus
MDLSSLRGSSSLTLSFIVLPLASTGSYGSTFTFANRCGFTVWPGILANAGSPTLSTTGFELPKGTSRSLQAPTGWSGRFWARTGCSFDGSGSGTCKTGDCGSNQVECVGLGAAPPVTLAEFTLGTGGDDFYDVSLVDGYNFR

SEQ ID NO: 525 - protein, 543 aa, Raphanus sativus
  misc_feature (51)..(51): Xaa can be any naturally occurring amino acid
  misc_feature (74)..(74): Xaa can be any naturally occurring amino acid
  misc_feature (215)..(215): Xaa can be any naturally occurring amino acid
  misc_feature (218)..(218): Xaa can be any naturally occurring amino acid
  misc_feature (253)..(253): Xaa can be any naturally occurring amino acid
  misc_feature (435)..(435): Xaa can be any naturally occurring amino acid
MTLLLFYCFLTSLSLAHGASLIHISPTQPPTAYEKTIWENSTKKFIVAETXLYGPTYNNPQVIGDASVALAAQXTFRKDPLNGFQIYTGGWNISNHHYWASVGYTAGPLFAVAAVWFLGFGICLLVICMCHICHRSTSIGYSRVAYFLSLIFLLFFTLMAIIGCVMLYSGQIRYNESTTETLAYVMSQADSTVSQLKAISDYLTSARQIGVLHVXLPXNVQTEIDQIGAKLSTSIATITDKATSSSNNIRNFXNSVRVALIVVSIVMLILTFLGLASSIFGMQVIVYTLVILGWILVTGTFILSGTFLLLHNATADTCVAMSEWVERPSSNTALDEILPCTDNATAQETLMRSKEVTGQLVELINTVVSNVSNINFSPVFVQMYYNQSGPLLPLLCNPFNHDLTDRPCSPGELDLNNATQAWTPFVCQVNQNGTXITTGRLTPALYGQMASCVNISTGLINDAPFLVQLQDCSYAKQTFRDITNNNCPGLRRYGYRVYVGLAMLSTAVMLSLVFWIIYSRERRHRKQALPEYSESKEIVRVNF

SEQ ID NO: 526 - protein, 620 aa, Brassica napus
  misc_feature (2)..(3): Xaa can be any naturally occurring amino acid
  misc_feature (15)..(15): Xaa can be any naturally occurring amino acid
  misc_feature (262)..(262): Xaa can be any naturally occurring amino acid
MXXFASVAALLLLLXFPVAFSGHDYGQALSKSLLFFEAQRSGVLPRNQRVTWRSHSGLTDGKSSGVNLVGGYYDAGDNVKFGLPMAFTVTMMAWSVIEYGNQLAANGELGHSIDAIKWGTDYFIKAHPEPNVLYGEVGDGNTDHYCWQRPEEMTTDRKAYRIDPSNPGSDLAGETAAAMAAASIVFRRSNPAYSRLLLTHAYQLFDFADKYRGKYDSSITVARKYYGSVSGYNDELLWAAAWLYQASNNQFYLDYLGRNGDXMGGTGWSMTEFGWDVKYAGVQTLVAKFLMQGKAGRHTAVFQKFQQKADFFMCSLLGKGSRNIQKTPGGLIFRQRWNNMQFVTSASFLTTVYSDYLTSSRSYLRCSAGNVAPSQLLSFAKSQVDYILGDNPRATSYMVGYGNNFPQRVHHRGSSIVSYKVDRSFVTCRGGYATWFSRKGSDPNLLTGAIVGGPDAYDNFADRRDNYEQTEPATYNNAPLLGVLARLSSGHSGYSQLLPAVPAPVVVRRPMPIRKPRVTSPVRASGPVAIVQKMTGSWVSKGRTYYRYSTTVTNKSPRALKSLNLSIKNLYGPIWGLSRSGNSFGLPSWMHSLQSGKSLEFVYIHSTTPANVAVSSYTLA

SEQ ID NO: 527 - protein, 269 aa, Raphanus sativus
  misc_feature (204)..(204): Xaa can be any naturally occurring amino acid
MEKFASVTALLLLLCFPVAFSGHDYGQALSKSLLFFEAQRSGVLPSSQRVTWRSHSGLNDGKSSGVNLVGGYYDAGDNVKFGLPMAFTVTMMVWSVIEYGNQLAANGELGHSIDAIKWGTDYFIKAHPEPNVLYGEVGDGNTDHYCWQRPEEMTTDRKAYRIDPSNPGSDLAGETAAAMAAASIVFRRSNPAYSSFYSLTLISXLISRTNTEENTTAASPSLVNTTDPSVVTMTSYSGQLHGYTKHPTTSSTWTTWVRTVTPWVVLVGP

SEQ ID NO: 528 - protein, 232 aa, Brassica napus
  misc_feature (9)..(10): Xaa can be any naturally occurring amino acid
  misc_feature (15)..(15): Xaa can be any naturally occurring amino acid
  misc_feature (18)..(18): Xaa can be any naturally occurring amino acid
  misc_feature (21)..(21): Xaa can be any naturally occurring amino acid
  misc_feature (132)..(132): Xaa can be any naturally occurring amino acid
  misc_feature (135)..(135): Xaa can be any naturally occurring amino acid
  misc_feature (138)..(138): Xaa can be any naturally occurring amino acid
  misc_feature (155)..(155): Xaa can be any naturally occurring amino acid
  misc_feature (171)..(171): Xaa can be any naturally occurring amino acid
  misc_feature (183)..(183): Xaa can be any naturally occurring amino acid
GRGFGRGEXXSTGMXEKXKKXKKIKKKKDTKSSPDISFKPSSAVKGLKFGGQIIVKSFTIRRARTLELLKLLSLPSSSSPSPPLLSTAAYLPTNFTILAHQAWHTLTLGLGTRKSKVVVFVFETEAMKTAVXAAXGGXWPSEIPLGEVNKKMIRXLKNWEMARFKFRKGCXTFYVYAVRNAGXEGFAAAEDLKVILQAVVALKDFMDHTAMLVMPHQKAINYSSCPPFAMAH

SEQ ID NO: 529 - protein, 339 aa, Malus domestica
MDHAADAHRTDLMTLTRFVLNEQSKRPESRGDFTILLNHIVLGCKFVCSAVNKAGLAKLIGLAGETNVQGEEQKKLDVLSNEVFVKALVSSGRTSILVSEEDEEAIFVEPKLRGKYCVVFDPLDGSSNIDCGVSIGTIFGIYVVKDGEPSLDDVLQPGKNMVAAGYCMYGSSCTLVISTGSGAHGFTLDPSLGEFILTHPDIQIPKKGKIYSVNEGNAKNWDGPTAKYVQKCKYPEDGSSPKSLRYIGSMVADVHRTLLYGGIFLYPADKKSPNGKLRVLYEVFPMSFLLEQAGGQSFTGKERALDLVPTKIHERSPIFLGSYDDVEEIKALYAAEGKE

SEQ ID NO: 530 - protein, 341 aa, Aquilegia formosa
MDHESATHNTDIMTITRHVLNEQSKYPESRGDFSILLSHIVLGCKFVCSAVNKAGLAKLIGLAGETNVQGEEQKKLDVLSNEVFVKALVSSGRTCILVSEEDEEAIFVEPSKRGKYCVVFDPLDGSSNIDCGVSIGTIFGIYMIKDGGEPILEDVLQSGKHMVAAGYCMYGSSCTFVLSTGSGVNGFTLDPSLGEFIMTHPDIKIPKKGKIYSVNEGNAKNWDGPTTKYVEKCKFPTDGSSPKSLRYIGSMVADVHRTLLYGGVFLYPGDKKSPNGKLRVLYEVFPMSFLMEQAGGQAFTGKERALDLVPKKIHERSPIFLGSYDDIEEIKALYAAEQKTA

SEQ ID NO: 531 - protein, 340 aa, Artemisia annua
MDHEADAFRTDLMTITRFVLNEQSKHPESRGDFSILLSHIVLGCKFVCAAVNKAGLAKLIGLAGETNVQGEEQKKLDVLSNEVFVKALVSSGRTCILVSEEDEEAIIVEPSKRGKYCVVFDPLDGSSNIDCGVSIGTIFGIYMIKDGDDPSLEDVLQPGKNMLAAGYCMYGSSCTFVLSTGSGVNGFTLDPSLGEFILTHPDIKIPKKGKIYSVNEGNAKNWDGPTAKFVEKCKYPTDGSSAKSLRYIGSMVADVHRTLLYGGVFLYPADKKSPDGKLRVLYEVFPMSFLMEQAGGQSFTGKIRSLDLVPKKIHERSPIFLGSYDDVEEIKALYAAEEKA

SEQ ID NO: 532 - protein, 346 aa, Brassica juncea
TLISREKEREHEADAYRTDLMTITRFVLNEQSKYPESRGDFTILLSNIVLGCKFVCSAVNKAGLAKLIGLAGETNIQGEEQKKLDVLSNDVFVKALVSSGRTSVLVSEEDEEATLVESSKRGKYCVVFDPLDGSSNIDCGVSIGTIFGIYTMSHNDEPTTEDVLKPGHEMVAAGYCMYGSSCMLVLSTGTGVNGFTLDPSLGEFILTHPDIKIPKKGNIYSVNEGNAQNWDGPTTKYVEKCKFPKDGSPAKSLRYVGSMVADVHRTLLYGGIFLYPADKKSPNGKLRVLYEVFPMSFLMEQAGGQAFTGKKRALDLVPEKIHERSPIFLGSYEDVEEIKALYAADE

SEQ ID NO: 533 - protein, 338 aa, Brassica oleracea
  misc_feature (318)..(318): Xaa can be any naturally occurring amino acid
MDHEADAYRTDLMTITRFVLNEQSKYPESRGDFTILLSNIVLGCKFVCSAVNKAGLAKLIGLAGETNIQGEEQKKLDVLSNDVFVKALVSSGRTSVLVSEEDEEATLVESSKRGKYCVVFDPLDGSSNIDCGVSIGTIFGIYTMSHNDEPTTEDVLKPGNEMVAAGYCMYGSSCMLVLSTGTGVNGFTLDPSLGEFILTHPDIKIPKKGNIYSVNEGNAQNWDGPTTKYVEKCKFPKDGSPAKSLRYVGSMVADVHRTLLYGGIFLYPADKKSPNGKLRVLYEVFPMSFLMEQAGGQAFTGKKRALDLVPEKIHERSXIFLGSYEDVEEIKALYAAEE

SEQ ID NO: 534 - protein, 338 aa, Brassica rapa
MDHEADAYRTDLMTITRFVLNEQSKYPESRGDFTILLSNIVLGCKFVCSAVNKAGLAKLIGLAGETNIQGEEQKKLDVLSNDVFVKALVSSGRTSVLVSEEDEEATLVESSKRGKYCVVFDPLDGSSNIDCGVSIGTIFGIYTMSHNDEPTTEDVLKPGHEMVAAGYCMYGSSCMLVLSTGTGVNGFTLDPSLGEFILTHPDIKIPKKGNIYSVNEGNAQNWDGPTTKYVEKCKFPKDGSPAKSLRYVGSMVADVHRTLLYGGIFLYPADKKSPNGKLRVLYEVFPMSFLMEQAGGQAFTGKKRALDLVPEKIHERSPIFLGSYEDVEEIKALYAADE

SEQ ID NO: 535 - protein, 341 aa, Musa acuminata
MDHEAEAHRTDLMTITRYVLNEQSRHQESRGDFTILLSHIVLGCKFVCSAVNKAGLAKLIGLAGETNVQGGSKRKLDVLSNEVFVKALISSGRTCILVSEEDEEATFVDPSLRGKYCVVFDPLDGSSNIDCGVSIGTIFGVYMVKDKDNVTLDEVLQPGKNMLAAGYCMYGSSCTLVLSTGSGVNGFTLDPSLGEFILTHPDIKIPKKGKIYSVNEGNAKNWDGPTTKYVEKCKFPKDGDSPKSLRYIGSMVADVHRTLLYGGIFLYPADKKSPNGKLRVLYEVFPMSFLMEQAGGQAFTGKQRALDLVPTKIHQRSPIFLGSYDEVEEIKALYAAEENTA

SEQ ID NO: 536 - protein, 344 aa, Hordeum vulgare
MDHAADTFRTDLMTITRHVLNEQSRHPESRGDLTILLSHIVLGCKFVASAVNKAGLAKLTGLAGETNVQGEEQKKLDVLSNEVFVNALVSSGRTCVLVSEEDEEATFVDPKLRGKYCVCFDPLDGSSNIDCGVSIGTIFGIYMIKNQDTVTLEEVLQPGKDMIAAGYCMYGSSCTLVLSTGNGVNGFTLDPSLGEFIMTHPDIKIPPKGKIYSVNEGNAKNWDTPTAKYVEKCKYPTDGSSPKSLRYIGSMVADVHRTLLYGGIFLYPADKKSPNGKLRVMYEVFPMSFLMEEAGGQSFTGKGRSLDLIPTDIHERSPIFLGSSDDVEEIKALYAEEAKKAGSA

SEQ ID NO: 537 - protein, 341 aa, Hordeum vulgare
MDHAAEAQRTDLMTITRHALNEQGRHPESRGDFTILLSHIVLGCKFVASAVNKAGLAKLIGLAGDTNIQGEEQKKLDVLSNEVFVKALISSGRTCLLVSEENEAAIFVDAPLRGKYCVCFDPLDGSSNIDCGVSIGTIFGIYMIKDKDNATLEDVLQPGTDMIAAGYCMYGSSCTLVLSTGNGVNGFTLDPSLGEFILTHPNIKIPSKGKIYSVNEGNARNWDGPTAKYVERCKFPQDGSSPKSLRYIGSMVADVHRTLLYGGIFLYPADKKSPNGKLRVLYEVFPMSFLMEQAGGQSFTGKQRALEIVPCDIHQRSPIFLGSYDDVEEIKSLYASESSTA

SEQ ID NO: 538 - protein, 341 aa, Phaseolus coccineus
MDHSADAHRTDLMTITRFVLNEQSKHPESRGDFTILLSHIVLGCKFVCTAVNKAGLAKLIGLAGETNIQGEEQKKLDVLSNEVFIKALVSSGRTCILVSEENEDAIIVEPSKRGKYCVVFDPLDGSSNIDCGVSIGTIFGIYTLADVHEPTVEDVLLPGKKMVAAGYCMYGSSCTLVLSTGAGVNGFTLDPSLGEFILTHPDIKIPNKGKIYSVNEGNAKNWDGPTAAYVEKCKFPEDGSSPKSLRYIGSMVADVHRTLLYGGIFLYPGDKKNPNGKLRVLYEVFPMSFLMEQAGGQSFTGKERALDLVPTKLHERSPIFLGSYDEVEEIKALYAAEGEEE

SEQ ID NO: 539 - protein, 341 aa, Phaseolus coccineus
MDHSADAQRTDLMTITRFVLNEQSKQPEARGDFSILLSHIVLGCKFVCSAVNKAGLAKLIGLAGETNVQGEEQKKLDVLSNDVFVKALVSSGRTCILVSEEDEEATFVEPSKRGKYIVVFDPLDGSSNIDCGVSIGTIFGIYLVKENGEPTIEDVLQPGKNMLAAGYCMYGSSCTFVLSTGTGVNGFTLDPSLGEFILTHPDIKVPKKGKIYSVNEGNAKNWDGPTTKYVENCKFPKDGSSPKSLRYVGSMVADVHRTFLYGGIFLYPADKKSPNGKLRVLYEVFPMSFLMEQAGGQAFTGKQRALDLVPTKLHERSPIFLGSYEDVEEIKALYAADQTLE

SEQ ID NO: 540 - protein, 341 aa, Beta vulgaris
MDHAADATRTDLMTITRFVLNEQSKRPESRGDFTILMSHIVLGCKFVCSAVNKAGLAKLIGLAGETNIQGEEQKKLDVLSNEVFIKALISSGRTCILVSEEDEEATFVEPSLRGKYCVVFDPLDGCSNIDCGVSIGTIFGIYMVKDLNNATLDDVLQPGKNMVAAGYCMYGSSCTLVMSTGSGVNGFTHDPSLGEFILTHPDIKIPKKGKIYSVNEGNAKNWDGPTTKYVEKCKFPKDGSSPKSLRYIGSMVADVHRTLLYGGIFMYPGDKKSPNGKLRVLYEVFPMSFLMEQAGGQAFTGEQRALDLVPKNIHDRSPVFLGSYDDVEDIKALYAAEQKNA

SEQ ID NO: 541 - protein, 343 aa, Brachypodium distachyon
MDHAADAHRTDLMTITRHVLNEQSKYPESRGDLTILLSHIVLGCKFVASAVNKAGLAKLTGLAGETNVQGEEQKKLDVLSNEVFVNALVSSGRTCVLVSEEDEEATFVAPALRGKYCVCFDPLDGSSNIDCGVSIGTIFGIYMIKNQDTVTLEEVLQPGKDMIAAGYCMYGSSCTLVLSTGNGVNGFTLDPSLGEFIMTHPDIKIPPKGKIYSVNEGNAKNWDTPTAKYVEKCKFPTDGSSPKSLRYIGSMVADVHRTLLYGGIFLYPADKKSPNGKLRVMYEVFPMSFLMEQAGGQSFTGKERALDLIPTKIHERSPIFLGSSDDVEEIKALYAEQAKATSA

SEQ ID NO: 542 - protein, 341 aa, Brachypodium distachyon
MDHAAEAQRTDLMTITRHALNEQGRHPESRGDFTILLSHIVLGCKFVASAVNKAGLAKLIGLAGVTNVQGEEQKKLDVLSNEVFVKALVSSGRTCVLVSEENEEAIFVDAPLRGKYCVCFDPLDGSSNIDCGVSIGTIFGIYMIKEKDNATLEDVLQPGTDMIAAGYCMYGSSCTLVLSTGNGVNGFTLDPSLGEFILTHPNIKIPKKGKIYSVNEGNAQNWDAPTAKFVEKCKFPQDGTSAKSLRYIGSMVADVHRTLLYGGIFLYPADKKSPNGKLRILYEVFPMSFLMEQAGGQAFTGKQRALELVPTEIHQRSPIFLGSYDDVEEMKSLYASESSTA

SEQ ID NO: 543 - protein, 266 aa, Brassica napus
MDHEADAFRTDLMTITRFVLNEQSKYPESRGDFTILLSNIVLGCKFVCSAVNKAGLAKLIGLAGDTNIQGEEQKKLDVLSNDVFVKALVSSGRTSVLVSEEDEEATFVESSKRGKYCVVFDPLDGSSNIDCGVSIGTIFGIYTMEHSDEPTTKDVLKPGNEMVAAGYCMYGSSCMLVLSTGTGVHGFTLDPSLGEFILTHPDIKIPKKGNIYSVNEGNAQNWDGPTTKYVERCKYPKDGSPAKSLRYVGSMVADVHRTLLYGGIFL

SEQ ID NO: 544 - protein, 338 aa, Brassica napus; identical to SEQ ID NO: 534

SEQ ID NO: 545 - protein, 341 aa, Manihot esculenta
MDHAADAHRTDLMTITRFVLNEQSKHPASRGDFTILLNHIVLGCKFVCSAVNKAGLAKLIGLAGETNVQGEEQKKLDVLSNEVFIKALVSSGRTCILVSEEDDEAIFVEPGKRGKYCVVFDPLDGSSNIDCGVSIGTIFGIYMVKHGNEPTLDDVLQPGSNMVAAGYCMYGSSCMLVLSTGSGVNGFTLDPSLGEFILTHPDIKIPKKGKIYSVNEGNAKNWDGPTAKYVERCKFPKDGSSPKSLRYVGSMVADVHRTLLYGGIFLYPADKKSPNGKLRVLYEVFPMSFLMEQAGGQSFTGKQQALHLVPEKIHQRSPIFLGSYDDVEEIKALYAAENAEA

SEQ ID NO: 546 - protein, 341 aa, Ricinus communis
MDHAADAHRTDLMTITRFVLNEQSKHPDSRGDFTILLSHIVLGCKFVCSAVNKAGLAKLIGLAGETNVQGEEQKKLDVLSNEVFIKALVSSGRTCILVSEEDDKATFVEPAMRGKYCVVFDPLDGSSNIDCGVSIGTIFGIYMVKHGNEPTLDDVLQPGKNMVAAGYCMYGSSCMFVLSTGNGVNGFTLDPSLGEFILTHPDIKIPKKGKIYSVNEGNAKNWDDPTAKYVENCKFPKDGSSPKSLRYVGSMVADVHRTFLYGGIFLYPADKKSPNGKLRVLYEVFPMSFLVEQAGGQAFTGQQRALDLIPTKIHERSPIFLGSYDDVEEIKALYAAEAKRA

SEQ ID NO: 547 - protein, 341 aa, Centaurea maculosa
MDHNADAFRTDLMTITRFVLNEQSKHPESRGDFSILLSHIVLGCKFVCSAVNKAGLAKLIGLAGETNVQGEEQKKLDVLSNEVFVKALVSSGRTCILVSEEDEDAIIVEPSKRGKYCVVFDPLDGSSNIDCGVSIGTIFGIYMIKDGGEPSLEDVLQPGKNMLAAGYCMYGSSCTLVLSAGSGVNGFTLDPSLGEFILTHPDIKIPKKGKIYSVNEGNAKNWDGPTAKYVEKCKFPTDGSSAKSLRYIGSMVADVHRTLLYGGIFLYPADKKSPNGKLRVLYEVFPMSFLMEQAGGQSFTGKERSLDLVPKKIHERSPIFLGSYDDVEEIKALYAAEEKKA

SEQ ID NO: 548 - protein, 341 aa, Cichorium intybus
MDHAADAFRTDLMTITRFVLNEQSKHPESRGDFSILLSHIVLGCKFVCSTVNKAGLAKLIGLAGETNVQGEEQKKLDVLSNEVFVKALVSSGRTCILVSEEDEEAIMVEPSKRGKYCVVFDPLDGSSNIDCGVSIGTIFGIYMIKDGDEARLEDVLQPGKNMLAAGYCMYGSSCTLVLSTGSGVNGFTLDPSLGEFILTHPDIKIPKKGKIYSVNEGNAKNWDGPTAKFVEKCKFPTDGSSAKSLRYIGSMVADVHRTLLYGGIFLYPADKKSPSGKLRVLYEVFPMSFLMEQAGGQSFTGKERALDLVPKKIHERSPIFLGSYDDVEEIKALYAAEEKAN

SEQ ID NO: 549 - protein, 392 aa, Citrus sinensis
MDHEADAHRTDLMTITRFVLNEQSKHPESRGDFSILLSHIVLGCKFVCSAVNKAGLAKLIGLAGETNVQGEEQKKLDVLSNDVFVKALISSGRTCILVSEEDEEAIFVEPSKRGKYCVVFDPLDGSSNIDCGVSIGTIFGIYMMKDSHEPTLDDVLQPGNNMLAAGYCMYGSSCTLVLSTGSGVNGFTLDPSLGEFILTHPDIKIPKKGKIYSVNEGNAKNWDGPTAKYVEKCKFPKDGSSPKSLRYIGSMVADVHRTLLYGGIFMYPRDKKSPNGKLRVLYEVFPMSFLMEQAGGQSFTGKQRALDLVPKKIHERSPIFLGSYDDVEEIKALSMLRKRRKNELVNSIFHDAYISLSDPISDQLSITCYKTFIKVPLCIGNDTVPVQAIYFE

SEQ ID NO: 550 - protein, 179 aa, Coffea canephora
MVAAGYCMYGSSCTLVLSTGSGVNGFTLDPSLGEFILTHPEIKIPKKGKIYSVNEGNARNWDAPTAKYVEKCKFPKDGSSAKSLRYIGSMVADVHRTLLYGGIFLYPADKKSPNGKLRVLYEVFPMSFLMEQAGGQAFTGKERALDLFPKKIHERSPIFLGSYDDVEEVKALYAEEQKA

SEQ ID NO: 551 - protein, 341 aa, Gossypium hirsutum
MDHAADAHRTDLMTITRFVLNEQSKYPESRGDFTILLNHIVLGCKFVCSSVNKAGLAKLIGLTGEINIQGEEQKKLDVLSNEVFIKALVSSGRTCILVSEEDEDAIIVEPSKRGRYCVVFDPLDGSSNIDCGVSIGTIFGIYMVKDDHEPTLADVLQPGKQMVAAGYCMYGSSCTLVLSTGKGVNGFTLDPSLGEFILTHPDIRIPKKGKIYSVNEGNAKNWDGPTAKYVENCKFPKDGSPSKSLRYIGSMVADVHRTLLYGGTFMYPADKKSPSGKLRVLYEVFPMSFLMENAGGQAFTGKQRALDLVPTKIHDRSPIFLGSYDDIEEIKALYAAEGKKE

SEQ ID NO: 552 - protein, 341 aa, Gossypium hirsutum
  misc_feature (26)..(26): Xaa can be any naturally occurring amino acid
MDHAADAHRTDLMTITRFVLNEQSKXPESRGDFTILLNHIVLGCKFVCSAVNKAGLAKLIGLAGETNVQGEEQKKLDVLSNEVFVKALVSSGRTCILVSEEDEEATFVDPSKRGRYCVVFDPLDGSSNIDCGVSIGTIFGIYMMKDNHEPTLDDVLQPGKQMLAAGYCMYGSSCTLVLSTGEGVNGFTLDPSLGEFILTHPGIKIPKKGKIYSVNEGNAKNWDGPTAKYVEKCKFPKDGSSSKSLRYIGSMVADVHRTLLYGGIFLYPADKKSPSGKLRVLYEVFPMSFLMEQAGGQAFTGKQRALDLVPTKIHERSPIFLGSFDDVEDIKALYAAEGKKE

SEQ ID NO: 553 - protein, 341 aa, Vigna unguiculata
MDHSADAQRTDLMTITRFVLNEQSKQPEARGDFTILLSHIVLGCKFVCSAVNKAGLAKLIGLAGETNVQGEEQKKLDVLSNDVFVKALVSSGRTCILVSEEDEEATFVEPSKRGKYIVVFDPLDGSSNIDCGVSIGTIFGIYLVKENREPTIEDVLQPGKNMLAAGYCMYGSSCTFVLSTGRGVNGFTLDPSLGEFILTHPDIKVPKKGKIYSVNEGNAKNWDGPTTKYVENCKFPKDGSSPKSLRYVGSMVADVHRTFLYGGIFLYPADKKSPNGKLRVLYEVFPMSFLMEQAGGQAFTGKERALDLVPTKLHERSPIFLGSYEDVEEIKALYAADQKLE

SEQ ID NO: 554 - protein, 304 aa, Cynara scolymus
  misc_feature (271)..(271): Xaa can be any naturally occurring amino acid
  misc_feature (284)..(284): Xaa can be any naturally occurring amino acid
MDHAADAFRTDLMTITRFVLNEQSKHPESRGDFSILLSHIVLGCKFVCAAVNKAGLAKLIGLAGETNVQGEEQKKLDVLSNEVFVKALVSSGRTCILVSEEDEDAIIVEPSKRGKYCVVFDPLDGSSNIDCGVSIGTIFGIYMIKDGGEPSLEDVLQPGKNMLAAGYCMYGSSCTLVLSTGSGVNGFTLDPSLGEFILTHPDIKIPKKGKIYSVNEGNAKNWDGPTAKYVEKCKFPTDGSSAKSLRYIGSMVADVHRTLLYGGVFLYPADXKSPDGKLRVSMKXPYVVLDGTAGVSHYWKGAVT

SEQ ID NO: 555 - protein, 341 aa, Taraxacum officinale
MDHEADAFRTDLMTITRFVLNEQSKHPESRGDFSILLSNIVLGCKFVCSAVNKAGLAKLIGLAGETNVQGEEQKKLDVLSNEVFVKALVSSGRTSILVSEEDEEAIFVEKSKRGKYCVVFDPLDGSSNIDCGVSIGTIFGIYMIKDGNDACIEDVLQPGKEMLAAGYCMYGSSCTLVLSTGSGVNGFTLDPSLGEFILTHPDIKIPKKGKIYSVNEGNAKNWDGPTAKYVERCKYPTDGSPAKSLRYIGSMVADVHRTLLYGGIFLYPADKKSPDGKLRVLYEVFPMSFLMEQAGGQSFTGKERSLDLVPKKIHERSPIFLGSYDDVEEIKALYAAEGKGN

SEQ ID NO: 556 - protein, 341 aa, Eucalyptus gunnii
MDHAGDAYRTDLMTITRFVLNEQSRHPESRGDFTILLSHIVLGCKFVCSCVNKAGLAKLIGLAGETNVQGEEQKKLDVLSNEVFVKALVSSGRTSILVSEEDEEATFVESAKRGKYCVVFDPLDGSSNIDCGVSIGTIFGIYMIKHANDPTLEDVLQPGKNMLAAGYCMYGSSCTLVLSTGCGVNGFTLDPSLGEFILTHPDIKIPKKGKIYSVNEGNAKNWDGPTAKYVEKCKFPKDGSSSKSLRYIGSMVADVHRTLLYGGVFLYPADKKSPSGKLRVLYEVFPMSFLMEQAGGQAFTGKQRALDLIPTKIHERSPIFLGSYDDVEEIKALYAAEEDKK

SEQ ID NO: 557 - protein, 343 aa, Festuca arundinacea
  misc_feature (105)..(105): Xaa can be any naturally occurring amino acid
MDHAADTYRTDLMTITRYVLNEQSRFPESRGDLTILLSHIVLGCKFVASAVNKAGLAKLTGLAGETNVQGEEQKKLDILSNEVFVNALVSSGRTCVLVSEEDELXTFVDPKLRGKYCVCFDPLDGSSNIDCGVSIGTIFGIYMIKNFDTVTLEEVLLPGKDMIAAGYCMYGSSCTLVLSTGSGVNGFTLDPSLGEFIMTHPEIKIPPKGKIYSVNEGNAKNWDTPTAKYVEKCKYPTDGSSPKSLRYIGSMVADVHRTLLYGGIFLYPADKKSPNGKLRVMYEVFPMSFLMEQAGGQSFTGKGRSLDLIPTNIHERSPIFLGSYDDVEEIKALYAEEAKAGSA

SEQ ID NO: 558 - protein, 341 aa, Zingiber officinale
MDHEADAHRTDLMTITRYVLNEQSRYPESRGDFSILLSHIVLGCKFVCTAVNKAGLAKLIGLAGETNVQGEEQKKLDVLSNEVFVKALISSGRTCILVSEEDEEATFVDPSLRGKYCVVFDPLDGSSNIDCGVSIGTIFGIYMVKDKENVTLNDVLQPGKNMLAAGYCMYGSSCMLVLSTGSGVNGFTLDPSLGEFILTHPYIKIPKKGKIYSVNEGNAKNWDRPTTKYVEKCKFPDDGSSPKSLRYVGSMVADVHRTLLYGGIFLYPSDKKSPDGKLRVLYEVFPMSFLMEQAGGQSFTGKQRALDLVPTKIHERSPIFLGSYDDVEEIKALYAAEENND

SEQ ID NO: 559 - protein, 339 aa, Vitis vinifera
MDHEADSHRTDLMTITRYVLNEQSRHPESRGDFTILLSHIVLGCKFVCTAVNKAGLAKLIGLAGETNVQGEEQKKLDVLSNEVFIKALVSSGRTCILVSEEDEEATIVEPSKRGRYCVVFDPLDGSSNIDCGVSIGTIFGIYMVKDGGEPTLDNVLQPGKNMLAAGYCMYGSSCTLVLSTGTGVNGFTLDPSLGEFILTHPNIKIPKKGKIYSVNEGNTKNWDAPTAKYVEKCKFPKDGSSPKSLRYIGSMVADVHRTLLYGGIFLYPADKKSPNGKLRVLYEVFPMSFLMEQAGGQAFTGKQRALDLVPKNIHERSPIFLGSYDDVEEIKALYAAEEK

SEQ ID NO: 560 - protein, 341 aa, Mesembryanthemum crystallinum
MDHEADAYRTDLMTITRHVLNEQSKHPESRGDFTILLSNIVLGCKFVCSAVNKAGLAKLIGLAGETNIQGEEQKKLDVLSNDVFVKALISSGRTCILVSEEDEEATFVEPSKRGKYCVVFDPLDGSSNIDCGVSIGTIFGIYMIKNYDNPTLDDVLKSGRNMLAAGYCMYGSSCTLVLSSGNGVNGFTLDPSLGEFILTHPDIKIPKKGKIYSVNEGNAKNWDGPTAKYVERCKFPKDGSSPKSLRYIGSMVADVHRTLLYGGIFMYPADKKSPNGKLRVLYEVFPMSFLIEQAGGQAFTGKQQALDLIPTQIHERSPVFLGSYDDVEEIKALYAAEEKSA

SEQ ID NO: 561 - protein, 338 aa, Ipomoea nil
MDHAADAHRTDLMTITRFVLNEQTKHPESRGDFTILLSHIVLGCKFVCTAVNKAGLAKLIGLAGETNVQGEEQKKLDVLSNEVFIKALVSSGRTSILVSEEDDEATFVKPPLRGKYCVVFDPLDGSSNIDCGVSIGTIFGIYMIKDNHEPELSDVLQPGKNMLAAGYCMYGSSCTFVLSTGSGVNGFTLDPSLGEFILTHPDIKIPKKGKIYSVNEGNAKNWDGPTAKFVENCKFPKDGSSPKSLRYIGSMVADVHRTLLYGGIFLYPADKKSPNGKLRVLYEVFPMSFLMEQAGGQAFTGKLRALDLVPEKIHERSPIFLGSYDDVEAIKALYAAED

SEQ ID NO: 562 - protein, 341 aa, Lactuca sativa
MDHAADAFRTDLMTITRFVLNEQSKHPESRGDFSILLSHIVLGCKFVCSAVNKAGLAKLIGLAGETNVQGEEQKKLDVLSNEVFVKALVSSGRTCILVSEEDEDAIIVEPSKRGRYCVVFDPLDGSSNIDCGVSIGTIFGIYMIKDGDEATLEDVLQPGKNMVAAGYCMYGSSCTLVLSTGSGVNGFTLDPSLGEFILTHADIKIPKKGKIYSVNEGNAKNWDGPTAKFVEKCKYPTDGSSAKSLRYIGSMVADVHRTLLYGGVFLYPADKKSPNGKLRVLYEVFPMSFLMEQAGGQSFTGKERALDLVPKKIHERSPIFLGSYDDVEEIKALYAAEEKAN

SEQ ID NO: 563 - protein, 344 aa, Leymus cinereus x Leymus triticoides
MDHAADTFRTDLMTITRHVLNEQSKHPESRGDLTILLSHIVLGCKFVASAVNKAGLAKLIGLAGETNVQGEEQKKLDVLSNEVFVNALVSSGRTCVLVSEEDEEATFVDPKLRGKYCVCFDPLDGSSNIDCGVSIGTIFGIYMIKNQDTVTLEEVLQPGKDMIAAGYCMYGSSCTLVLSTGNGVNGFTLDPSLGEFIMTHPDIKIPPKGKIYSVNEGNAKNWDTPTAKYVEKCKYPTDGSSPKSLRYIGSMVADVHRTLLYGGIFLYPADKKSPNGKLRVMYEVFPMSFLMEEAGGQSFTGKGRSLDLIPTNIHERSPIFLGSSDDVEEIKALYAEEAKKAGSA

SEQ ID NO: 564 - protein, 343 aa, Eragrostis curvula
  misc_feature (83)..(83): Xaa can be any naturally occurring amino acid
  misc_feature (85)..(86): Xaa can be any naturally occurring amino acid
MDHAAEAHQTDLMTLTRHVLNEQSRNPESRGDFTILISHIVLGCKFVASAVNKAGLAKLIGLAGETNIQGEEQKKLDVLSNEXFXXALVSSGRTCILVSEEDEEATFVDPALRGKYCVCFDPLDGSSNIDCGVSIGTIFGIYMVKDKDNVTLNDVLQPGKNMLAAGYCMYGSSCTLVLSTGNGVNGFTLDPSLGEFILTHPNIKIPKKGKIYSVNEGNAKNWDEPTAKFVEKCKYPKDGSPPRSLRYIGSMVADIHRTLLYGGVFLYPADQKSPNGKLRVLYEVFPMSFLMEEAGGQSFTGKERALDLVPTKIHERSPIVLGSYDDVEEIKALYAEQAKSSSG

SEQ ID NO: 565 - protein, 341 aa, Zea mays
MDHAAEAQRTDLMTITRHVLNEQSRHPESRGDFTILLSHIVLGCKFVAAAVNKAGLAKLIGLAGETNVQGEEQKKLDVLSNEVFVKALVSSGRTCVLVSEENEEAIFVDPALRGKYCVCFDPLDGSSNIDCGVSIGTIFGIYMVKDKDNVTLEDVLQPGTNMLAAGYCMYGSSCTLVLSTGNGVNGFTLDPSLGEFILTHPNIKIPRKGKIYSVNEGNAKNWDGPTAKFVEKCKYPEDGSPPRSLRYIGSMVADVHRTLLYGGIFLYPADQKSPNGKLRVLYEVFPMSFLMEQAGGQAFTGKQRALELAPAKLHDRSPVFLGSYDDVEEIKALYASMSNSG

SEQ ID NO: 566 - protein, 345 aa, Zea mays
MDHAADAHRTDLMTITRHVLNEQSRNPESRGDFTILLSHIVLGCKFVASAVNKAGLAQLIGLAGETNVQGEEQKKLDVLSNEVFVKALVSSGRTCVLVSEEDEEATFVDPKLRGRYCVCFDPLDGSSNIDCGVSIGTIFGIYIIKDKDNVTLEDVLQPGKNMLAAGYCMYGSSCTLVLSTGTGVNGFTLDPSLGEFILTHPDIKIPKKGKIYSVNEGNAKNWDAPVAKFVEKCKYPKDGSPPRSLRYIGSMVADVHRTLLYGGVFLYPADEKNPNGKLRILYEVFPMSFLMEQAGGQSFTGKERALDLIPTKIHDRSPIFLGSYDDVEEIKALYAEQAKSSSASS

SEQ ID NO: 567 - protein, 342 aa, Medicago truncatula
MDHQADANRTDLMTITRFVLNEQSKYAESRGDFTILINHIVLGCKFVCSSVNKAGLAKILGLAGDTNVQGEEQKKLDVISNEVFVKALISSGRTCLLVSEEVEDAIIVPPAQRGKYIVVFDPLDGSSNIDCGVSIGTIFGIYTVKDTAEVSVEDALQPGSSLVAAGYCMYGSSCTFVLSTGNGVNGFTLDPSLGEFILTHPNIKIPKKGKIYSVNEGNAKNWDEPTAKYVENCKFPQEGSAPKSLRYIGSMVADVHRTLLYGGIFMYPADKKSPNGKLRVLYEVFPMSYLMEQAGGQAFTGKQRALDLVPKKIHDRSPIFLGSYDEIEHIKELYAESKENGA

SEQ ID NO: 568 - protein, 339 aa, Medicago truncatula
MDHSADAHRTDLMTITRFVLNEQSKHPESRGDFTILLNNIVLGCKFVCSAVNKAGLAKLIGLAGETNVQGEEQKKLDVLSNEVFCKALISSGRTCILVSEEDEDAIFVEPKQRGKYCVVFDPLDGSSNIDCGVSIGTIFGIYMMKDNHEPVIEDALQPGKNMLAAGYCMYGSSCTFVITTGSGVNGFTLDPSLGEFILTHPDIKIPKKGKIYSVNEGNAKNWDGPTAAYVEKCKFPTDGSPAKSLRYIGSMVADVHRTLLYGGTFLYPADKKSPNGKLRVLYEVFPMSFLMEQAGGQAFTGKERALDLIPTKLHERSPIFLGSYDDIEEIKALYAAEAK

SEQ ID NO: 569 - protein, 323 aa, Carica papaya
MDHAAEAHRTDLMTITRFVLNEQSKHPESRGDFTILLSHIVLGCKFVCSAVNKAGLAKLIGLAGDTNVQGEEQKKLDVLSNEVFIKALISSGRTCILVSEEDEEATFVECSKRGKYCVVFDPLDGSSNIDCGVSIGTIFGIYMVKDDEPTIDDVLQPGKNMLAAGYCMYGSSCMFVLSTGGGVNGFTLDPSLGEFILTHPDIKIPKKGKIYSVNEGNAKNWDGPTAKYVENCKFPKDGSSPKSLRYVGSMVADVHRTFLYGGIFLYPADKKSPNGKLRVLYEVFPMSFLVEQAGGQAFTGKERALDLVPKKIHERSPIFLGSY

SEQ ID NO: 570 - protein, 339 aa, Arachis hypogaea
MDHSADAHRTDLMTITRFVLNEQSKHPESRGDFTILLSHIVLACKFVCSSVNKAGLAKLIGLAGETNVQGEEQKKLDVLSNEVFIKALISSGRTSILVSEEDEEATFVEPSLRGKYCVVFDPLDGSSNIDCGVSIGTIFGIYMVNDVNEPTLEDVLQPGKNMLAAGYCMYGSSCTFVLTTGSGVNGFTLDPSLGEFILTHPDIKIPKKGKIYSVNEGNAKNWDGPTAFYVERCKFPKDGSSPKSLRYIGSMVADVHRTLLYGGIFLYPADKKSPNGKLRVLYEVFPMSFLMEQAGGQAFTGKQRALDLIPKKLHERSPIFLGSYDDVEEIKALYAAEAK

SEQ ID NO: 571 - protein, 340 aa, Arachis hypogaea
MDHSADAQRTDLMTITRFVLNEQSKHPDSRGDFSILLSHIVLGCKFVCSAVSKAGLAKLIGLAGDTNVQGEEQKKLDVLSNDVFVKALVSSGRTSILVSEEDEQATIVEPSKRGKYCVVFDPLDGSSNIDCGVSIGTIFGIYMLKDEHEPTLQDVLQPGKNMLAAGYCMYGSSCTLVISTGNGVNGFTLDPSLGEFILTHPDIKIPKKGKIYSVNEGNAKNWDAATTKYVEKCKFPKDGSSPKSLRYIGSMVADVHRTLLYGGIFLYPGDKKSPNGKLRVLYEVFPMSFLLEQAGGQAFTGKQRALDLVPNKLHERSPIFLGSFDDVEDIKALYAAQSQG

SEQ ID NO: 572 - protein, 340 aa, Capsicum annuum
MDHAADAHRTDLMTITRFVLNEQTKHPESRGDFSILLSHIVLGCKFVCSAVNKAGLAKLLGLAGETNVQGEDQKKLDVLSNEVFIKALVSSGRTCILVSEEDEEATFVEPAKRGKYCVVFDPLDGSSNIDCGVSIGTIFGICMIKEGHEPNLEDVLQPGMNMLAAGYCMYGSSCTLVLSTGSGVNGFTLDPSLGEFILTHPDIKIPKKGKIYSVNEGNAKNWDGPTTKYVQSCKYPTDGSSPKSLRYIGSMVADVHRTLLYGGIFLYPGDKKSPNGKLRVLYEVFPMSFLMEQAGGQAFTGKQRALDLVPEKIHERSPIFLGSYDDVEEIKKLYAAEEKN

SEQ ID NO: 573 - protein, 340 aa, Capsicum annuum
MDHAADAHRTDLMTITRFVLNEQTKYPESRGDFTILLSHIVLGCKFVCTAVNKAGLAKLLGLAGETNVQGEDQKKLDVLSNEVFIKALVSSGRTCILVSEEDEEATFVEPAKRGKYCVVFDPLDGSSNIDCGVSIGTIFGIYMMKDAHEPTLDDVLQPGKNMLAAGYCMYGSSCTLVLSTGKGVNGFTLDPSLGEFILTHPEIKIPKKGKIYSVNEGNAKNWDGPTSKYVESCKFPEDGSSPKSLRYIGSMVADVHRTLLYGGIFLYPADKKSPNGKLRVLYEVFPMSFLMEQAGGQAFTGKERALDLVPTKIHERAPIFLGSYDDVEEIKKLYAAEEKN

SEQ ID NO: 574 - protein, 339 aa, Physcomitrella patens
MDHAADAMRTDLMTITRHVLNEQSRFPEARGDLTILLNNIVLGCKFVCSSVSKAGLAKLIGLAGETNVQGEEQKKLDVLSNHVFINALVSSGRTNVLVSEENEEAIFVESSKRGRYCVVFDPLDGSSNIDCGVSIGTIFGIYMLKEGASGTVEDVLQPGTAMLAAGYCMYGSSCTLVLSTGAGVNGFTLDPSLGEFILTHPNIKIPKKGKIYSVNEGNAKHWDGPTTKYVENAKFPKDGSSPKSLRYIGSMVADVHRTLLYGGIFMYPGDKKSPKGKLRVLYEVFPMSFLVEQAGGQSFTGKQRALELVPAHIHDRSPIFLGSSDDVEEIKALYAAESA

SEQ ID NO: 575 - protein, 201 aa, Physcomitrella patens
MDHAADAMRTDLMTITRHVLNEQSKFPEARGDLTILLNNIVLGCKFVCSSVSKAGLAKLIGLAGETNVQGEEQKKLDVLSNDVFINALVSSGRTNVLVSEENEDAIFVEPSKRGRYCVVFDPLDGSSNIDCGVSIGTIFGIYMLKEGASGTVEDVLQPGTAMLAAGYCMYGSSCTLVLSTGAGVNGFTLDPSLGGVHLDAP

SEQ ID NO: 576 - protein, 342 aa, Pinus taeda
MDHAAEAHRTDLMTITRFVLNEQSKHPEARGDFTILLSHIVLGCKFVCSCVSKAGLARLIGLAGEVNVQGEQQKKLDVLSNEVFIKALISSGRTSILVSEEDEQATFVEPSKRGRYCVVFDPLDGSSNIDCGVSIGTIFGIYMLKDDSEGTLNDVLQPGKKMVAAGYCMYGSSCTLVLSTGTGVNGFTLDPSLGEFILTHPNIKVPEKGKIYSVNEGNTKNWDEPTKKYVERCKFPEDGSSPKSLRYIGSMVADVHRTLLYGGIFMYPADKKSPNGKLRTLYEVFPMSFLMEQAGGQAFTGTGRALDIVPTTIHQRSPIFLGSFEDIEEIKSLYAAYEAKTF

SEQ ID NO: 577 - protein, 341 aa, Pinus taeda
  misc_feature (133)..(133): Xaa can be any naturally occurring amino acid
MDHAADAYRTDLMTITRFVLNEQSKHPESRGDFSILLSRIVLGCKFVCSAVNKAGLAKLIGLAGETNVQGEEQKKLDVLSNEVFVKALVSSGRTCILVSEEDEEATFVEHSQRGKYCVVFDPLDGSSNIDCGXSIGTIFGIYLVKKEGEAALSDVLKPGKNMVAAGYCMYGSSCTLVLSSGSGVNGFTLDPSLGEFILTHPDIKIPKKGKIYSVNEGNAKNWDEPTRKYVERCKFPQDGSSPKSLRYIGSMVADVHRTLLYGGIFMYPADKKSPNGKLRVLYEVFPMSFLMEQAGGQAFTGSIRALDLVPTKIHQRSPIFLGSYDDVEEIKALYAAQEGKV

SEQ ID NO: 578 - protein, 341 aa, Populus trichocarpa
MDHAADAHRTDLMTITRFVLNEQSKYPESRGDFSILLNHIVLGCKFVCSVVNKAGLAKIIGLAGETNVQGEEQKKLDVLSNEVFIKALVSSGRTCILVSEEDEEATFVEPSRRGRYCVVFDPLDGSSNIDCGVSIGTIFGIYMVKDDHEPTLDDVLQPGKNMLAAGYCMYGSSCTFVLSTGTGVNGFTLDPSLGEFILTHPDIKIPKKGKIYSVNEGNVRNWDGPTAKYVEKCKFPQDGSSAKSLRYIGSMVADVHRTLLYGGIFLYPADKKSPNGKLRVLYEVFPMSFLMEQAGGQAFTGKQRALDLLPTKIHERSPIFLGSYDEVEEIKALYAAEEKKA

SEQ ID NO: 579 - protein, 71 aa, Populus trichocarpa
MDHSADAHRTDLMTITRFVLNEQSKYPESLGDFSILLNHIVLGCKFVCSAVNKAGLAKLIGLAGETNVQAS

SEQ ID NO: 580 - protein, 340 aa, Solanum tuberosum
MDHAADAHRTDLMTITRFVLNEQTKHPESRGDFSILLSHIVLGCKFVCTAVNKAGLAKLLGLAGETNVQGEDQKKLDVLSNEVFIKALVSSGRTCILVSEEDEEATFVEPANRGKYCVVFDPLDGSSNIDCGVSIGTIFGIYMIKDGHEPTLDDVLQPGMNMLAAGYCMYGSSCTLVLSTGSGVNGFTLDPSLGEFILTHPDIKIPKKGKIYSVNEGNAKNWDGPTSKYVQSCKYPADGSSPKSLRYIGSMVADVHRTLLYGGIFLYPGDKKSPNGKLRVLYEVFPMSFLMEQAGGQAFTGKQRALDLVPEKIHERSPIFLGSYDDVEEIKKLYAAEEQN

SEQ ID NO: 581 - protein, 340 aa, Prunus persica
  misc_feature (17)..(17): Xaa can be any naturally occurring amino acid
  misc_feature (82)..(82): Xaa can be any naturally occurring amino acid
  misc_feature (129)..(129): Xaa can be any naturally occurring amino acid
MDHAADAHRTDLMTITXFVLNEQSKHPESRGDFTILLNHIVLGCKFVCSAVNKAGLAKLIGLAGETNVQGEEQKKLDVLSNXVFVKALVSSGRTSILVSEEDEEAIFVEPSKRGKYCVVFDPLDGSSNXDCGVSIGTIFGIYVVKDGIEPTLHDVLQPGKNMVAAGYCMYGSSCTFVLSTGTGVHGFTLDPSLGEFILTHPDIQIPKKGKIYSVNEGNAKNWDGPTAKYVEKCKYPKDGSSPKSLRYIGSMVADVHRTLLYGGIFLYPADKKSPNGKLRVLYEVFPMSFLMEQAGGQSFTGKERALDLVPNKIHERSPIFLGSYDDVEEIKTLYAAEGKK

SEQ ID NO: 582 - protein, 338 aa, Raphanus sativus
MDHEADAYRTDLMTITRFVLNEQSKYPESRGDFTILLSNIVLGCKFVCSAVNKAGLAKLIGLAGETNIQGEEQKKLDVLSNDVFVKALVSSGRTSVLVSEEDEEATFVESSKRGKYCVVFDPLDGSSNIDCGVSIGTIFGIYTMSHNDEPTTEDVLKPGNEMVAAGYCMYGSSCMLVLSTGTGVNGFTLDPSLGEFILTHPDIKIPKKGNIYSVNEGNAQNWDGPTTKYVEKCKFPKDGSPAKSLRYVGSMVADVHRTLLYGGIFLYPADKKSPNGKLRVLYEVFPMSFLMEQAGGQAFTGKKRALDLVPEKIHERSPIFLGSYEDVEEIKALYAAED

SEQ ID NO: 583 - protein, 340 aa, Raphanus sativus
  misc_feature (317)..(317): Xaa can be any naturally occurring amino acid
MDHEADAYRTDLMTITRFVLNEQSKYPESRGDFTILLSNIVLGCKFVCSAVNKAGLAKLIGLAGETNIQGEEQKKLDVLSNDVFIKALVSSGRTSVLVSEEDEEATFVESSKRGKYCVVFDPLDGSSNIDCGVSIGTIFGIYTMNHSDEPSTEDVLKPGNEMVAAGYCMYGSSCMLVLSTGTGVHGFTLDPSLGEFILTHPDIKIPNKGNIYSVNEGNAQNWDGPTTKYVERCKYPKDGSPAKSLRYVGSMVADVHRTLLYGGIFLYPADKKSPNGKLRVLYEVFPMAFLMEQAGGQAFTGKKRALDLVPEKIHERXPIFLGSYDDVEEIKALYATEEKN

SEQ ID NO: 584 - protein, 339 aa, Oryza sativa
MDHEADAYRTDLMTITRYVLNEQSRNPEARGDLTILLSHIVLGCKFVASAVNKAGLAKLIGLAGETNVQGEEQKKLDVLSNEVFVKALVSSGRTCVLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQAK

SEQ ID NO: 585 - protein, 341 aa, Oryza sativa
MDHAAEAQRTDLMTITRHVLNEQGRHPESRGDFTILLSHIVLGCKFVASAVNKAGLAKLIGLAGDTNVQGEEQKKLDVLSNEVFVKALVSSGRTCVLVSEENEEAIIVDAPLRGKYCVCFDPLDGSSNIDCGVSIGTIFGIYMIKDKDNVTLDDVLQPGTDMLAAGYCMYGSSCTLVLSTGNGVNGFTLDPSLGEFILTHPNIKIPNRGKIYSVNEGNAKNWDAPTAKFVEKCKFPQDGSPSKSLRYIGSMVADVHRTLLYGGIFLYPADQKSPNGKLRVLYEVFPMSFLMEQAGGQAFTGKQRALELVPRKIHDRSPIFLGSYDDVEDIKALYASESIIG

SEQ ID NO: 586 - protein, 343 aa, Sorghum bicolor
MDHAADAHRTDLMTITRHVLNEQSRNPESRGDFTILLSHIVLGCKFVASAVNKAGLAQLIGLAGETNVQGEEQKKLDVLSNEVFVKALVSSGRTCVLVSEEDEEATFVDPKLRGKYCVCFDPLDGSSNIDCGVSIGTIFGIYMIKDKDNVTLADVLQPGKDMLAAGYCMYGSSCTLVLSTGSGVNGFTLDPSLGEFILTHPDIKIPKKGKIYSVNEGNAKNWDVPVAKFVEKCKYPEDGTPPKSLRYIGSMVADVHRTLLYGGVFLYPADQKSPNGKLRVLYEVFPMSFLMEQAGGQSFTGKERALDLVPTKIHDRSPIFLGSYDDVEEIKALYAEQAKSSSA

SEQ ID NO: 587 - protein, 341 aa, Sorghum bicolor
MDHAAEAQRTDLMTITRHVLNEQSRHPESRGDFTILLSHIVLGCKFVASAVNKAGLAKLIGLAGETNVQGEEQKKLDVLSNEVFVKALVSSGRTCVLVSEENEEAIFVDPALRGKYCVCFDPLDGSSNIDCGVSIGTIFGIYMIKDKDNVTLEDVLQPGTNMLAAGYCMYGSSCTLVLSTGNGVNGFTLDPSLGEFILTHPNIKIPKKGKIYSVNEGNAKNWDGPTAKFVEKCKYPQDGSSPKSLRYIGSMVADVHRTLLYGGIFLYPADQKSPNGKLRVLYEVFPMSFLMEQAGGQSFTGKQRALELAPAKLHDRSPIFLGSYDDVEEIKALYASESNNA

SEQ ID NO: 588 - protein, 342 aa, Glycine max
MDHQADTNRTDLMTITRFVLNEQSKYPESRGDFTILLSHIVLGCKFVCSAVNKAGLAKLIGLAGETNVQGEEQKKLDVLSNEVFVKALISSGRTCLLVSEEVEEAIFVPSSHRGKYIVVFDPLDGSSNIDCGVSIGTIFGIYMVKNEAEVSLEDALQPGNQMLAAGYCMYGSSCTFVLSTENGVNGFTLDPSLGEFILTHPNIKIPSKGKIYSVNEGNARNWDEPTTKYVQMCKFPQDGSPPKSLRYIGSMVADIHRTLLYGGIFMYPADAKSPNGKLRLLYEVFPMSYLMEQAGGQAFTGKQRALDLIPKKIHERSPVFLGSYDDIEQMKELYAASKEDDA

SEQ ID NO: 589 - protein, 342 aa, Glycine max
MDHSADAHRTDLMTITRFVLNEQSKHPESRGDFTILLSHIVLGCKFVCSAVSKAGLAKLIGLAGETNVQGEEQKKLDVLSNEVFIKALISSGRTCILVSEEDEEAIIVEPSKRGKYCVCFDPLDGSSNIDCGVSIGTIFGVYALKDVHEPTIEDVLLPGKNMVAAGYCMYGSSCTLVLSTGAGVNGFTLDPSLGEFILTHPDIKIPKKGKIYSVNEGNAKNWDGPTAAYVEKCKFPEDGSSPKSLRYIGSMVADVHRTLLYGGIFLYPADKKSPNGKLRVLYEVFPMSFLMEQAGGQSFTGKERALDLVPTKLHERSPIFLGSYDDVEEIKALYAAAEGEQE

SEQ ID NO: 590 - protein, 339 aa, Glycine max
MDHSADAQRTDLMTITRFVLNEQSKHPESRGDFSILLSHIVLGCKFVCSAVNKAGLAKLIGLAGETNVQGEEQKKLDVLSNDVFIKALISSGRTCILVSEEDEEATFVEPSKRGKYCVVFDPLDGSSNIDCGVSIGTIFGIYLIKEDHEPTVEDVLQPGKNMLAAGYCMYGSSCTLVLSTGSGVNGFTLDPSLGEFILTHPDIKVPKKGKIYSVNEGNAKNWDGPTTKYVENCKFPKDGSSPKSLRYIGSMVADVHRTFLYGGIFLYPADKKSPNGKLRVLYEVFPMSFLMEQAGGQAFTGNQRALDLVPKKLHERSPIFLGSYEDVEEIKALYSADEK

SEQ ID NO: 591 - protein, 338 aa, Glycine max
MDHSADAQRTDLMTITRFVLNQQSNHPESRGDFSILLSHIVLGCKFLCSAVNKAGLAKLIGLAGETNVQGEEQKKLDVLSNDVFIKALVSSGRTCILVSEEDEEATFVEASKRGKYCVVFDPLDGSSNIDCGVSIGTIFGIYLIKEDHEPTIEDVLQPGKNMLAAGYCMYGSSCTLVLSTGSGVNGFTLDPSLGEFILTHPDIKIPKKGKIYSVNEGNAKNWDDPTTKYVENCKYPRDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYAAEE

SEQ ID NO: 592 - protein, 339 aa, Selaginella moellendorffii
MDHQADAQRTDLMTITRFVLNEQSKHPEARGDLTILLSHIVLGCKFVCSAVNKAGLAKLIGLAGETNVQGEEQKKLDVLSNDVFVKALSSSGRTNVLVSEELEEAIFVEASHRGKYCVVFDPLDGSSNIDCGVSIGTIFGIFLLDHDNAGSNDDVLKPGSEMVAAGYCMYGSSCTLVFSTGSGVNGFTLDPSLGEFILTHPDIKIPKKGKIYSVNEGNAKNWDEPTRLYVENAKFPKDDSSPKSLRYIGSMVADVHRTLLYGGIFMYPADKKSPFGKLRVLYEVFPMSYLVEQAGGQAFTGKERALDLVPKHLHERSPIFLGSYDDVEEIKKLYSATIA

SEQ ID NO: 593 - protein, 341 aa, Picea glauca
MDHAADAYRTDLMTITRFVLNEQSKYPESRGDFSILLSHIVLGCKFVCSAVNKAGLAKLIGLAGETNVQGEEQKKLDVLSNEVFVKALVSSGRTCILVSEEDEEATFVEHSKRGKYCVVFDPLDGSSNIDCGVSIGTIFGIYLVKDGAEPTVGDVLKPGKNMVAAGYCMYGSSCTLVLSSGSGVNGFTLDPSLGEFILTHPDIRIPKKGKIYSVNEGNAKNWDEPTRKYVERCKFPQDGSSPKSLRYIGSMVADVHRTLLYGGIFMYPADKKSPNGKLRVLYEVFPMSFLMEQAGGQAFTGNIRALDLVPTKIHQRSPVFLGSYDDVEEIKALYAAQEGKA

SEQ ID NO: 594 - protein, 342 aa, Picea glauca
MDHAAEAHRTDLMTITRFVLNEQSKHPEARGDFTILLSNIVLGCKFVCSAVSKAGLAKLIGLAGEINVQGEEQKKLDVLSNEVFIKALISSGRTSILVSEENEQATFVEPSKRGRYCVVFDPLDGSSNIDCGVSIGTIFGIYLRKDDSEGTLNDVLQPGKNMVAAGYCMYGSSCTLVLSTGTGVNGFTLDPSLGEFILTHPDIKVPKKGKIYSVNEGNAKNWDEPTKKYVERCKFPEDGSSPKSLRYIGSMVADVHRTLLYGGIFMYPADKKSPNGKLRTLYEVFPMSFLMEQAGGQAFTGTGRALDIVPTTIHQRSPIFLGSFEEVEEIKSLYAAHESKTL

SEQ ID NO: 595 - protein, 338 aa, Euphorbia esula
MDHEADAYRTDLMTITRFVLNEQSRHPDSRGDFTILLSNIVLGCKFVCTAVNKAGLAKLIGLAGETNVQGEEQKKLDVLSNEVFVKALVSSGRTCILVSEEDEEPTYVEASKRGKYCVVFDPLDGSSNIDCGVSIGTIFGIYMVKHTNAPTLEDVLQPGKNMVAAGYCMYGSSCTLVLSTGSGVNGFTLDPSLGEFILTHPDVKIPKKGKIYSVNEGNAKNWDGPTAKYVEKCKYPTDGSPAKSLRYIGSMVADVHRTLLYGGIFLYPADKKSPNGKLRVLYEVFPMSFLMEQAGGQAFTGKLRALDLEPEKIHERSPIFLGSYDDVEEIKALYAAEG

SEQ ID NO: 596 - protein, 341 aa, Fragaria vesca
MDHEADAYRTDLMTMTRFVLNEQSKHPESLGDFTILLSHIVLGCKFVCSAVNKAGLAKLIGLAGETNVQGEEQKKLDVLSNEVFVKALVSSGRTCILVSEEDEDAIFVEPSKRGKYCVVFDPLDGSSNIDCGVSIGTIFGIYALYDGGEPKLDDVLQPGKNMVAAGYCMYGSSCTFVLTTGSGVHGFTLDPSLGEFILTHPNIKIPKKGKSYSVNEGNAKNWDGPTAKYVEKCKFPTDGSPPKSLRYIGSMVADVYRTLLYGGIFLYPGDKKSPNGKLRVLYEVFPMSFLLEQAGGQAFTGKERALDLVPKKIHERSPIFLGSYDDVEEIKALYAAEEKKE

SEQ ID NO: 597 - protein, 343 aa, Saccharum officinarum
MDHAADAHRTDLMTITRHVLNEQSRNPESRGDFTILLSHIVLGCKFVASAVNKAGLAQLIGLAGETNVQGEEQKKLDVLSNEVFVKALVSSGRTCVLVSEEDEETTFVDPKLRGKYCVCFDPLDGSSNIDCGVSIGTIFGIYMIKDKDNVTLSDVLQPGKDMLAAGYCMYGSSCTLVLSTGTGVNGFTLDPSLGEFILTHPDIKIPKKGKIYSVNEGNAKNWDVPVAKFVEKCKYPKDGSPPKSLRYIGSMVADVHRTLLYGGVFLYPADQKSPNGKLRVLYEVFPMSFLMEQAGGQSFTGKERALDLVPTKIHERSPIFLGSYDDVEEIKALYAEQAKSSSA

SEQ ID NO: 598 - protein, 327 aa, Helianthus annuus
  misc_feature (285)..(285): Xaa can be any naturally occurring amino acid
MDHAADAMKTDLMTITRFVLNEQSKHPESRGDFSILLSHIVLGCKFVCAAVNKAGLAKLIGLAGETNVQGEEQKKLDVLSNEVFVKALVSSGRTCILVSEEDEEAIFVEPSKRGKYCVVFDPLDGSSNIDCGVSIGTIFGVYMLKDGAESRLEDVLQPGKNMLAAGYCMYGSSCTFVLSTGSGVNGFTLDPSLGEFILTHPDIKIPKKGKIYSVNEGNAKNWDGPTAKFVEKCKFPKDGSPAKSLRYIGSMVADVHRTLLYGGVFLYPADKKSPNGKLRVLYEVXPMSFLMEQAGGQSFTGKERALDLVPKKIHERSPIFLGSYDDV

SEQ ID NO: 599 - protein, 340 aa, Helianthus annuus
MDHAADAMHTDLMTITRFVLNEQSKYPESRGDFSILLSHIVLGCKFVCAAVNKAGLAKLIGLAGETNVQGEEQKKLDVLSNEVFVKALVSSGRTCILVSEEDEEAIIVEPSKRGKYCVVFDPLDGSSNIDCGVSIGTIFGIYMIKDAGAARLEDVLQPGKNMLAAGYCMYGSSCTLVLSTGSGVNGFTLDPSLGEFILTHPDIKIPKKGKIYSVNEGNAKNWDGPTAKFVEKCKFPKDGSPAKSLRYIGSMVADVHRTLLYGGVFLYPADKKSPNGKLRVLYEVFPMSFLMEQAGGQSFTGKERALDLVPKKIHERSPIFLGSYDDVEEIKALYAAEEKA

SEQ ID NO: 600 - protein, 343 aa, Panicum virgatum
MDHTADAHRTDLMTITRHVLNEQSRNPESRGDFTILLSHIVLGCKFVASAVNKAGLAKLIGLAGETNVQGEEQKKLDVLSNEVFVKALVSSGRTCILVSEEDEEATFVDPALRGKYCVCFDPLDGSSNIDCGVSIGTIFGIYMIKDKDNVTLEDVLQPGTNMLAAGYCMYGSSCTLVLSTGSGVNGFTLDPSLGEFILTHPDIKIPKKGKIYSVNEGNAKNWDAAVAKFVEKCKYPKDGSPPKSLRYIGSMVADVHRTLLYGGVFLYPADKKSPNGKLRVLYEVFPMSFLMEQAGGQSFTGKERALDLVPTKIHERSPVFLGSYDDVEEIKALYAELAKTSSA

SEQ ID NO: 601 - protein, 142 aa, Panicum virgatum
  misc_feature (66)..(68): Xaa can be any naturally occurring amino acid
  misc_feature (78)..(78): Xaa can be any naturally occurring amino acid
  misc_feature (87)..(87): Xaa can be any naturally occurring amino acid
MDHAAEAQRTDLMTITRHVLNEQGRHPESRGDFTILLSHIVLGCKFVASAVNKAGLAKLVGLAGEXXXRVRSRRSWMXCPTRSLSRXSSAAAAPAFLCLKRTRRPFSSTRNSVGSTAFVSIRWMAPQTSTVVSPSEQSSGFT

SEQ ID NO: 602 - protein, 340 aa, Solanum lycopersicum
MDHAADAHRTDLMTITRFVLNEQSKYPESRGDFTILLSHIVLGCKFVCTAVNKAGLAKLLGLAGETNVQGEDQKKLDVLSNEVFIKALVSSGRTCILVSEEDEEATFVEPSKRGKYCVVFDPLDGSSNIDCGVSIGTIFGIYMMKDVHEPTLDDVLQPGKNMLAAGYCMYGSSCTLVLSTGKGVNGFTLDPSLGEFILTHPDIKIPKKGKIYSVNEGNAKNWDGPTSKYVESCKFPTDGSSPKSLRYIGSMVADVHRTLLYGGIFLYPADKKSPNGKLRVLYEVFPMSFLMEQAGGQAFTGKERALDLVPTKIHERAPIFLGSYDDVEEIKRLYAAEEKN

SEQ ID NO: 603 - protein, 340 aa, Solanum lycopersicum
MDHAADAHRTDLMTITRFVLNEQTKHPESRGDFSILLSHIVLGCKFVCTAVNKAGLAKLLGLAGETNVQGEDQKKLDVLSNEVFIKALVSSGRTCILVSEEDEEATFVEPANRGKYCVVFDPLDGSSNIDCGVSIGTIFGIYMIKDGHEPTLDDVLQPGMNMLAAGYCMYGSSCTLVLSTGSGVNGFTLDPSLGEFILTHADIKIPKKGKIYSVNEGNAKNWDGPTSKYVQNCKYPADGSSPKSLRYIGSMVADVHRTLLYGGIFLYPGDKKSPNGKLRVLYEVFPMSFLMEQAGGQAFTGKQRALDLVPEKIHERSPIFLGSYDDVEEIKNLYAAEEQN

SEQ ID NO: 604 - protein, 340 aa, Triphysaria pusilla
  misc_feature (13)..(13): Xaa can be any naturally occurring amino acid
  misc_feature (56)..(56): Xaa can be any naturally occurring amino acid
  misc_feature (128)..(128): Xaa can be any naturally occurring amino acid
MDHAADAYRTDLXTITRHVLNEQSKHPESRGDFTILLSHIVLGCKFVCSAVSKAGXAKLIGLAGETNVQGEEQKKLDVLSNEVFIKALVSSGRTCILVSEEDEEATFVEPSHRGKYCVVFDPLDGSSXIDCGVSIGTIFGIYAIYDGHDPKLEDVLQPGKNMLAAGYCMYGSSCTFVLSTGSGVNGFTLDPSLGEFILTHPDIKIPKKGKIYSVNEGNAKNWDGPTAKYVEKCKYPTDGSPAKSLRYIGSMVADVHRTLLYGGVFLYPADKKSPNGKLRVLYEVFPMSFLMEQAGGQAFTGKERALDLLPQKIHDRSPIFLGSYDDIEEIKALYAAEEQK

SEQ ID NO: 605 - protein, 340 aa, Triphysaria pusilla
MDHAADAHRTDLMTITRHVLNEQSKHPESRGDFTILLSHIVLGCKFVCSAVNKAGLAKLIGLAGETNVQGEEQKKLDVLSNEVFIKALVSSGRTCILVSEEDEEATFVEPSHRGKYCVVFDPLDGSSNIDCGVSIGTIFGIYAIYDGHDPKLEDVLQPGKNMLAAGYCMYGSSCTFVLSTGSGVNGFTLDPSLGEFILTHPDIKIPKKGKIYSVNEGNAKNWDGPTAKYVEKCKYPTDGSPAKSLRYIGSMVADVHRTLLYGGVFLYPADKKSPNGKLRVLYEVFPMSFLMEQAGGQAFTGKERALDLVPKNIHDRSPIFLGSYDDVEEIKILYAAEEQK

SEQ ID NO: 606 - protein, 344 aa, Triticum aestivum
MDHAADTFRTDLMTITRHVLNEQSRHPESRGDLTILLSHIVLGCKFVASAVNKAGLAKLTGLAGETNVQGEEQKKLDVLSNEVFVNALVSSGRTCVLVSEEDEKATFVDPKLRGKYCVCFDPLDGSSNIDCGVSIGTIFGIYMIKNQDTVTLEEVLQPGKDMIAAGYCMYGSSCTLVLSTGNGVNGFTLDPSLGEFIMTHPDIKIPPKGKIYSVNEGNAKNWDTPTAKYVEKCKYPTDGSSPKSLRYIGSMVADVHRTLLYGGIFLYPADKKSPSGKLRVMYEVFPMSFLMEEAGGQSFTGKGRSLDLIPTDIHERSPIFLGSSDDVEEIKALYAEEAKKAGSA

SEQ ID NO: 607 - protein, 344 aa, Triticum aestivum; identical to SEQ ID NO: 606

SEQ ID NO: 608 - protein, 344 aa, Triticum aestivum
MDHAADTFRTDLMTITRHVLNEQSRHPESRGDLTILLSHIVLGCKFVASAVNKAGLAKLTGLAGETNVQGEEQKKLDVLSNEVFVNALVSSGRTCVLVSEEDEKATFVDPKLRGKYCVCFDPLDGSSNIDCGVSIGTIFGIYMIKNQDTVTLEEVLQPGKDMIAAGYCMYGSSCTLVLSTGNGVNGFTLDPSLGEFIMTHPDIKIPPKGKIYSVNEGNAKNWDTPTAKYVEKCKYPTDGSSPKSLRYIGSMVADVHRTLLYGGIFLYPADKKSPSGKLRVMYEVFPMSFLMEEAGGQSFTGKGRSLDLIPTDIHERSPIFLGSSDDVEEIKALYAEEAKKEGSA

SEQ ID NO: 609 - protein, 2098 aa, Ricinus communis
MEDPDGTLASVAQCIEQLRQSSSSLQEKEHSLRQLLELIETRENAFSAVGSHSQAVPVLVSLLRSGSLGVKIQAATVLGSLCKENELRVKVLLGGCIPPLLGLLKSSSADGQIAAAKTIYAVSQGGARDHVGSKIFSTEGVVPVLWELLKNGLKTGNLVDNLLTGALKNLSSSTEGFWSATIQAGGVDILVKLLTTGQSGTQANVCFLLACMMMEDASICSKVLAAEATKQLLKLIGTGNDAPVRAEAAGALKSLSAQCKEARREIANHNGIPVLINATIAPSKEFMQGEHAQALQEHAMCALANISGGLSYVISSLGQSLESCSSPAQTADTLGALASALMIYDSQAESTRASDPMSIEQTLVQQFKPRLPFLVQERTIEALASLYGNAILSIKLANSEAKRLLVGLITMATNEVQDELVRALLTLCNNEGSLWRALQGREGVQLLISLLGLSSEQQQECAVALLCLLSNENDESKWAITAAGGIPPLVQILETGSAKAKEDSATILRNLCNHSEDIRACVESADAVPALLWLLKNGSPNGKEIAAKTLNHLIHKSDTATISQLTALLTSDLPESKVYVLDALRSMLCMVSLNDILREGSASNDAIETMIKILSSTKEETQAKSASALAGIFEVRKDLRESSIAVKTLWSVMKLLNVESENILVESSRCLASIFLSIKENRDVAAVAQDALSPLVTLANSSALEVAEQATCALANLILDTEASETATPEEIILPATRVLHEGTVSGKTHAAAAIAHLLHSRRIDYAVTDCVNRAGTVLALVSFLDSANGKSIATSEALDALAILSRSGGASEHIKPTWAVLAEFPKSITPIVSSIADATPLLQDKAIEILSRLCRDQPVVLGKAVVSASGCIPSVARRVISSANPKVKIGGVAVLICAAKVSHERVVEDLNQSNSCTHLIQSLVAMLNSAETSLGTEGDVKEAISICRHTPEESGNGDSNAETALVYGYNLAIWLLSVLACHDGKSKTVIMDAGAVEVLTDRISHCYMQYSQSEFIEDSSIWICALLLAILFQDRDIIRAHATMKSIPVLANLLKSEDSANRYFAAQAIASLVCNGSRGTLLSVANSGAAGGLISLLGCADVDIADLLELSEEFALVRYPDQVTLERLFRVEDIRVGATSRKAIPALVDLLKPIPDRPGAPFLALGLLTQLAKDCPPNKIVMVESGALEALTKYLSLGPQDATEEAATDLLGILFSSAEIRRHESAFGAVSQLVAVLRLGGRGARYSAAKALESLFSADHIRNAETSRQAVQPLVEILNTGMEKEQHAAIAALVRLLSENPSRALAVADVEMNAVDVLCRILSSNCSMELKGDAAELCGVLFGNTRIRSTMAAARCVEPLVSLLVTEFSPAQHSVVRALDKLVDDEQLAELVAAHGAVIPLVGLLYGRNYMLHEAISRALVKLGKDRPACKLEMVKAGVIESILDIFYEAPDFLCASFAELLRILTNNASIAKGASAAKVVEPLFLLLTRPEFGPDGQHSALQVLVNILEHPQCRADYNLTSHQAIEPLIPLLDSAAPAVQQLAAELLSHLLLEEHLQKDPVTQQIIGPLIRVLGSGIHILQQRAVKALVSIALMWPNEIAKEGGVTELSRVILQADPSLPHALWESAASVLASILQFSSEFYLEVPVAVLVRLLRSGSESTVVGALNALLVLESDDGTSAEAMAESGAIEALLELLRCHQCEETAARLLEVLLNNVKIRESKATKAAILPLSQYLLDPQTQAQQARLLATLALGDLFQNEGLARSTDAVSACRALVNVLEEQPTEEMKVVAICALQNLVMYSRSNKRAVAEAGGVQVVLDLIGSSDPDTSVQAAMFVKLLFSNHTIQEYASSETVRAITAAVEKDLWATGTVNEEYLKALNSLFSNFPRLRATEPATLSIPHLVTSLKTGSEATQEAALEALFLLRQAWSACPAEVSRAQSIAAADAIPLLQYLIQSGPPRFQEKAEFLLQCLPGTLVVIIKRGNNMKQSVGNPSVYCKLTLGNTPPRQTKVVSTGPNPEWDESFAWSFESPPKGQKLHISCKNKSKMGKSSFGKVTIQIDRVVMLGAVAGEYTLLPESKTGPSRILEIEFQWSNK

SEQ ID NO: 610 - protein, 2116 aa, Populus trichocarpa
MAATLAWRLSATNGSSLATADLEKNGDLKIQDSEPPTPHSVMKMGVRDRTSSMEDPDGTLASVAQCIELLRQSSSSVQEKEYALRQLRELVETRENAFSAVGSHSQAVPVLVSLLRSGSLGVKIQAATVLGSLCKENELRVKVLLGGCIPPLLGLLKSSSAEGQIAAAKTIYAVSQGGAKDHVGSKIFSTEGVVPALWELLRNGLKTGNLVDNLLTGALKNLSSSTEGFWSATIQAGGVDILVKLLTTGQSDTQANVCFLLACMMMQDASICFKVLAAEATKQLLKLLGPGNEASVRAEAAGALKSLSAQCKDARQEIAKSNGIPALINATIAPSKEFMQGEYAQALQENAMCALANISGGLSFVISSLGQSLESCSSPAQAADTLGALASALMIYDSKAESTRASDPVAIEQTLVNQFKPRLPFLVQERTIEALASLYGNAILSVKLVNSEAKRLLVGLITMAINEVQDELVRALLTLCNNEGSLWRALQGREGVQLLISLLGLSSEQQQECAVALLCLLSNENDESKWAITAAGGIPPLVQILETGSAKAKEDSATILRNLCNHSEDIRACVESADAVPALLWLLKNGSPNGKEIAAKTLNHLIHKSDTATISQLTALLTSDLPESKVYVLDALRSMLSVVPLSDVLRDGSAANDAIETMIKILSSTKEETQAKSASALAGIFETRKDLRESSIENREVAAVARDALSPLIALANSSTLEVAEQATCALANLILDGEVSKKAIPNEIIVPATRVLREGTISGKTHAAAAIARLLHSRRIDNSITDCVNRAGTVLALVSFLESASGGSAATSEALAALAILSRSEGTSGHIKPAWAVLAEFPKRITPIVLSIADATPLLQDKAIEILSRLCRDQPFVLGEAVACASGCIPSVARRVINSTNPKVKIGGAALLICAAKVSHQRVVEDLNQSNSCSHLIQSLVTMLCSADASPSEDLVDDDKEVISIHRYAKEGENGESHKGTAVIYGYNLAVWLLSVLACHDEKSKIVIMEAGAVEVLTNRISSCISHYSQSDFSEDSSIWICALLLAILFQDRDIIRAHATMKSIPVLASMLKSEESANRYFAAQAIASLVCNGSRGTLLSVANSGAAGGLISLLGCADGDISDLLELSEVFALVRYPDQVALERLFRVEDIRVGATSRKAIPALVDLLKPIPDRPGAPFLSLGLLNQLAKDCPPNKTVMVESGVLEALTKYLSLGPQDATEEAATDLLGILFNSAEIRRHEAAFGAVSQLVAVLRLGGRAARYSAAKALESLFSADHIRNADTARQAVQPLVEILNTGLEKEQHAAIAALVRLLSENPSRALAVADVEMNAVDVLCRILSSNCSMELKGDAAELCGVLFGNTRIRSTMAAARCVEPLVSLLVTEFSPAQYSVVCALEKLVDDEQLAELVAAHGAVIPLVGLLYGRNYMLHEAISRALVKLGKDRPACKMEMVKAGVIESILDILHEAPDFLGAAFAELLRILTNNASIAKGPSAAKVVEPLFLQLTRPEFGPDGQHSALQVLVNILEHPQCRADYTLTSHQTIEPLIPLLDSPAPAVQQLAAELLSHLLMEEHLQKDSVTQQVIGPLIRVLGSGIHILQQRAVKALVSIALIWPNEIAKEGGVSELSKVILQADPSLPHALWESAASVLASILQFSSEFYLEVPVAVLVRLLRSGLESTVVGALNALLVLESDDGTSAEAMAESGAIEALLELLRSHQCEETAARLLEVLLNNVKIRESKVTKSAILPLSQYLLDPQTQAQQARLLATLALGDLFQNEGLARSTDAVSACRALVNVLEEQPTEEMKVVAICALQNLVMYSRSNKRAVAEAGGVQVVLDVIGSSDPDTSVQAAMFVKLLFSNHTIQEYASSETVRAITAAIEKDLWATGTVNEEYLKALNALFSNFPRLRATEPATLSIPHLVTSLKTGSEATQEAALDALFLLRQAWSACPAEVSRAQSIAAADAIPLLQYLIQSGPPRFQEKAEFLLQCLPGTLVVIIKRGNNMKQSVGNPSVYCKITLGSTPPRQTKVVSTGPNPEFEESFSWSFESPPKGQKLHISCKNKSKMGKSSFGKVTIQIDRVVMLGAVAGEYTLLPQSKSGPSRNLEIEFQWSNK

SEQ ID NO: 611 - protein, 2151 aa, Populus trichocarpa
MAATLAWRLSATNGSSLATTDLEKNGNLKTQDSEPPTPRSVMKMGVRDRTGSMEDPDGTLASVAQCIEQLRRSSSSVQEKEYALRQLRELVETRENAFSAVGSHSQAVPVLVSLLRSGSLGVKIQAATVLGSLCKENELRVKVLLGGCIPPLLGLLKSSSEEGQIAAAKTIYAVSQGGAKDHVGSKIFSTEGVVPVLWELLRNGLKTGKLVDNLLTGALKNLSSSTEGFWSATIQAGGVDILVKLLTTGQSDTQANICFLLACMMMEDESICSKVLAAEATKQLLKLLGPGNEASVRAEAAGALKSLSAQCKDARQEIAKSNGIPALINATIAPSKEFMQGEYAQALQEHAMCALANISGGLSFVISSLGQSLESCSSPAQTADTLGALASALMIYDSKAESTRASDPVVIEQTLVNQFNPHLPYLVQERTIEALASLYGNAILSVKLANSEAKRLLVGLITMATNEVQDELVRALLALCNNEGSLWRSLQGREGVQLLISLLGLSSEQQQECAVALLCLLSNENDESKWAITAAGGIPPLVQILETGSAKAKEDSATILRNLCNHSEDIRACVESADAVPALLWLLKNGSLNGKEIAAKTLNHLIHKSDTATISQLTALLTSDLPESKVYVLDALRSMLSVVHLSDVLREGSAANDAIETMIKILSSTKEETQAKSASALAGIFETRKDLRESSISVKTLWSVMKLLNVESENILAESSHCLASIFLSIKENRDVAAVARDALSPLIALANSSTLEVAEQATCALANLILDGEVSKKAIPNEIIVPATRVLREGTISGKTHAAAAIARLLHSRRIDNSITDCVNHAGTVLALVSFLESAIGRSAATSEALAALAILSRSEGASGHIKPAWAVLAEFPNHISPIVSSIADATPLLQDKAIEILSRLCRDQPFVLGNAVASASGCIPSVARRAIDSTSPKVKIGGAALLICAAKVSHQRVVEDLNQSNSCNHLIQSLVTMLCSADTSPSGNLVDDDREVISIYRHAKEGESGESHKATAVIYDYNLAVWLLSVLACHGEKSKIVIMEAGAVEVLTNRISSCYLQYSQSDFSEDSSIWICALLLAILFQDRDIIRAHATMKSIPALANLLKSEESANRYFAAQAIASLVCNGSRGTLLSVANSGAAGGLISLLGCADGDISDLLELSEEFALVCYPDQVALERLFRVEDIRVGATSRKAIPALVDLLKPIPDRPGAPFLALGLLNQLAKDCPPNKTVMVESGILEALTKYLSLGLQDATEEAATDLLGILFSSAEIRRHEAAFGAVSQLVAVLRMGGRAARYSAAKALESLFSADHIRNADTARQAVQPLVEILNTGLEKEQHAAIAALVRLLSENPSRALAFADVEMNAVDVLCRILSSNCSTGLKGDAAELCGVLFGNTRIRSTMAAARCVEPLVSLLVTEFSPAQYSVVCALDKLVDDEQLAELVAAHGAVIPLVGLLYGGNYMLHEAISRALVKLGKDRPACKMEMVKAGVIESILDILHEAPDFLCAAFAELLRILTNNASIAKGPSAAKVVGPLFLLLTRPEFGPDGQHSALQVLVNILEHPQCRADYNLTSHQTIEPLIPLLDSQAPAVQQLAAELLSHLLMEEHLQKDPVTQQVIGPLIRVLSSGIHILQQRAVKALVSIALIWPNEIAKEGGVSELSKVILQADPSLPHVLWESAASVLANILQFSSEFYLEVPVAVLVRLLRSGLESTVVGALNALLVLESDDGTSAEAMAESGAIEALLELLRSHQCEETAARLLEVLLNNVKIRESKATKTAILPLSQYLLDPQTQAQQARLLATLALGDLFQNEGLARSTDAVSACRALVNVLEEQPTEEMKVVAICALQNLVMYSRSNKRAVAEAGGVQVVLDLIGSSDPDTSVQAAMFVKLLFSNHTIQEYASSETVRAITAAIEKDLWATGTVNEEYLKSLNALFSNFPRLRATEPATLSIPHLVTSLKTGSEASQEAALDALFLLRQAWSACPAEVSRAQSIAAADAIPLLQYLIQSGPPRFQEKAEFLLQCLPGTLVVIIKRGNNMKQSVGNPSVYCKLTLGNTPPRQTKVVSTGPNPEFDESFSWTFESPPKGQKLHISCKNKSKMGKSSFGKVTIQIDRVVMLGAVAGEYTLMPESKSGPSRNLEIEFQWSNK

SEQ ID NO: 612 - protein, 2101 aa, Glycine max
MEDPDGTLASVAQCIEQLRQSSSSMQEKEYSLKQLLELIDMRENAFSAVGSHSQAVPVLVSLLRSGSLNVKIQAATVLGSLCKENELRVKVLLGGCIPPLLGLLKSSSAEGQVAAAKTIFAVSQGGAKDHVGSKIFSTEGVVPVLWEQLQKGLKTGNVVDNLLTGALKNLSSSTERFWNATIQAGGVDILIKLLTTGQSSTLANVCFLLACMMMEDASVCSKLLTAEATKQLLKLLGPGNDAPVRAEAAGALKALSAQCKDARKEIANSNGIPALINATIAPSKEFMQGEYAQALQENAMCALANISGGLSYVISSLGQSLESCSSPTQAADTLGALASALMIYDDKAESTRASDPLVVEQTLLEQFKPGLPFLVQERTIEALASLYSNPILSIKLTNSDAKRLLVGLITMAANEVQDELLKSLLTLCNTECSLWLALQGREGVQLLISLLGLSSEQQQECAVSLLCLLSNENDESKWAITAAGGIPPLVQILESGSAKAKEDSATILRNLCDHSEDIRACVESADAVPALLWLLKNGSPNGKEIAAKTLNHLIHKSDTATISQLTALLTSDLPESKVYVLDALRSMLSVVALTDLLREGSAASDAIVTMIKLLSSTKEETQAKSASALAGIFETRKDVRESSIAVKTLWSAMKLLNVESESILMESSRCLAAIFLSIKENKDVAAIARDALLSLVALANSSVLEVAELATCAVANLILDSEIAEKAVAEEVILAATRVLREGTISGKTHAAAAIARLLHCKRQVDYAVTDCVNRAGTVLALVSFLDFAIDGHSSTSEALEALAMLSRSDVTGAHSKPAWAVLAEFPKSISPIVLSIADSTSVLQDKAIEILSRLCKDQPFVLGDSVVTASGCISSIAKRIINSTSKNVKVKIGGAAVLICAAKLNHQRLVEDLNRSNLCANLVQSLVDMLISSQATLDNQGDDSREVISICRHTKEANDGKSNTGTAIISGANLAVWLLSVLACHDEKSKIAIMEAGAIEVLTDRIADCFSQYSQIDYKEDSSMWICALLLAILFQDRDIIRAHATMKSIPALANLLKSEESANRYFAAQSIASLVCNGSRGTLLSVANSGAAGGLISLLGCADSDIQDLLELSDEFSLVHYPDQVALERLFRVDDIRIGATSRKAIPALVDLLKPIPERPGAPFLALGLLTQLSIDCPSNKIVMVEAGALEALSKYLSLGPQDATEEAATDLLGILFSSAEIRRHESAVGAVTQLVAVLRLGGRAARYRAAKALESLFSADHIRNAETARQAVQPLVEILNTGLEREQHAAIAALVRLLSENPSKALAVADVEMNAVDVLCRILSSDCSMDLKGDAAELCSVLFGNTRIRSTMAAARCVEPLVSLLVSEFSPAHHSVVRALDRLVDDEQLAELVAAHGAVIPLVGLLYGRNYVLHEAISRALVKLGKDRPACKMEMVKAGVIESILDILHEAPDYLCAAFAELLRILTNNASIAKGPSAAKVVEPLFMLLTREEFGPDGQHSALQVLVNILEHPQCRADYSLTSHQVIEPLIPLLDSPISAVQQLAAELLSHLLLEEHLQKDPVTQQVIGPLIRVLGSGIHILQQRAIKALVSIALIWPNEIAKEGGVIEISKVILQSDPSIPHALWESAASVLASILQFSSEYYLEVPVAVLVRLLRSGLESTVVGALNALLVLESDDGTSAEAMAESGAIEALLELLGSHQCEETAARLLEVLLHNVKIRETKVTKSAILPLSHYLLDPQTQAQQARLLATLALGDLFQNEGLARTSDAVSACRALVNVLEDQPTEEMKVVAICALQNLVMYSRSNKRAVAEAGGVQVILDLIGSSDPETSVQAAMFIKLLFSNHTIQEYASSETVRAITAAIEKDLWATGSVNDEYLKALNSLFSNFPRLRATEPATLSIPHLVTSLKTGSEATQEAALDALFLLRQAWSACPAEVSRAQSIAAADAIPLLQYLIQSGPPRFQEKAEFLLQCLPGTLVVIIKCGNNMKQSVGNPSVFCKLTLGNTPPRQTKVVSTGPNPEWDESFTWSFESPPKGQKLHISCKNKSKMGKSSFGKVTIQIDRVVMLGAVSGEYTLLPESKSGPSRNLEIEFQWSNK

SEQ ID NO: 613 - protein, 2101 aa, Glycine max
MEDPDGTLASVAQCIEQLRQSSSSMQEKEYSLKQLLELIDMRENAFSAVGSHSQAVPVLVSLLRSGSLNVKIQAATVLGSLCKENELRVKVLLGGCIPPLLGLLKSSSAEGQVAAAKTIFAVSQGGAKDHVGSKIFSTEGVVPVLWEQLQKGLKTGNVVDNLLTGALKNLSSSTERFWNATIQAGGVDILIKLLTTGQSSTLANVCFLLACMMMEDASVCSKLLTAETTKQLLKLLGPGNDAPVRAEAAGALKSLSAQCKDARKEIANSNGIPALINATIAPSKEFMQGEYAQALQENAMCALANISGGLSYVISSLGQSLESCSSPTQAADTLGALASALMIYDDKAESTWASDPLVVEQTLLEQFKPHLPFLVQERTIEALASLYSNPILSIKLTNSDAKRLLVGLITMAANEVQEELLKSLLTLCNTECSLWRALQGREGVQLLISLLGLSSEQQQECAVALLCLLSNENDESKWAITAAGGIPPLVQILESGSAKAKEDSATILRNLCDHSEDIRACVESAEVVPALLWLLKNGSPNGKEIAAKTLNHLIHKSDTATISQLTALLTSDLPESKVYVLDALRSMLSVVALTDLLREGSAASDAIVTMIKLLSSTKEETQAKSASALAGIFETRKDVRESSIAVKTLWSAMKLLNVESESILMESSRCLAAIFLSIKENKDMAAIARDALPSLAALANSSVLEVAELATCAVANLILDSEIAEKAVAEEVILAATRVLREGTISGKTHAAAAIARLLHSKRQVDYSVTDCVNRAGTVLALVSFLDFAIDEHSSTSEALEALAMLSRSDLTSAHSKPAWAVLAEFPKSIIPIVLSIADSTPVLQDKAIEILSRLCKDQPFVLGDTVVTASGCISSIAKRIINSTSKNVKVKIGGAAVLICAAKVNHQKLVEDLNLSNLCANLVQSLVDMLIFSQATLDNQGDDSREVISICRHTKEANDCKSSTGTALISSANLAIWLLSVLACHDEKSKIAIMEAGAIEVLTDRIADCFSQYSQIDYKEDSSMWICALLLAVLFQDRDIIRAHATMKSIPALANLLKSEESANRYFAAQSIASLVCNGSRGTLLSVANSGAAGGLISLLGCADSDIQDLLELSDEFSLVHYPDQVALERLFRVDDIRVGATSRKAIPALVDLLKPIPERPGAPFLALGLLTQLSIDCPSNKILMVEAGALEALSKYLSLGPQDATEEAATDLLGILFSSAEIRRHESAFGAVTQLVAVLRLGGRAARYRAAKALESLFSADHIRNAETARQAVQPLVEILNTGLEREQHAAIAALVRLLSENPSKALAVADVEMNAVDVLCRILSSDCSMDLKGDAAELCSVLFGNTRIRSTMAAAHCVEPLVSLLVSEFSPAHHSVVRALDRLVDDEQLAELVAAHGAVIPLVGLLYGRNHVLHEAISRALVKLGKDRPACKMEMVKAGVIESILDILHEAPDYLCAAFAELLRILTNNASIAKGPSAAKVVEPLFMLLTREEFGPDGQHSALQVLVNILEHPQCRADYTLTCHQVIEPLIPLLDSPISAVQQLAAELLSHLLLEEHLQKDPVTQQVIGPLIRVLGSGIHILQQRAVKALVSIALIWPNEIAKEGGVIEISKVILQSDPSIPHALWESAASVLASILQFSSEYYLEVPVAVLVRLLRSGLESTVVGALNALLVLESDDGTSAEAMAESGAIEALLELLRSHQCEETAARLLEVLLNNVKIRETKVTKSAILPLSHYLLDPQTQAQQARLLATLALGDLFQNEGLARTSDAVSACRALVNVLEDQPTEEMKVVAICALQNLVMYSRSNKRAVAEAGGVQVILDLIGSSDPETSVQAAMFIKLLFSNHTIQEYASSETVRAITAAIEKDLWATGSVNDEYLKALNSLFSNFPRLRATEPATLSIPHLVTSLKTGSEATQEAALNALFLLRQAWSACPAEVSRAQSIAAADAIPLLQYLIQSGPPRFQEKAEFLLQCLPGTLVVIIKRGNNMKQSVGNPSVFCKLTLGNTPPRQTKVVSTGPNPEWDESFTWSFESPPKGQKLHISCKNKSKMGKSSFGKVTIQIDRVVMLGAVSGEYTLLPESKSGPSRNLEIEFQWSNK

SEQ ID NO: 614 - protein, 146 aa, Brassica napus
MAWDLFLWILSFFVSLALVASVFYQVICLTDLEADYLNPFETSTRINRLILPEFILQGSLCVLFLITWHWVFFLAALPVTCYHAMLYKERRHLIDVTEVFRGISFEKKLRFTKLGFYIFLFIMVVFRLTLSAVYSFTEDDDLLHLF

SEQ ID NO: 615 - protein, 146 aa, Raphanus sativus
MAWDLFLWILSFFVSLALVASVFYQVICLTDLEADYLNPFETSSRINRLILPEFILQASLCILFLITWHWVFFLVALPVTCYHAMLYKERRHLIDVTEVFRGISFEKKLRFTKLGFYIFLFIMVVFRLTLSAVYSFTEDDDLLHLF

SEQ ID NO: 616 - protein, 146 aa, Raphanus sativus
MGWDLFLWILSFFVSLALVASVFYQVICLTDLEADYLNPFETSSRINRLILPEFILQASLCILFLITWHWVFFLVALPVTCYHAMLYKERRHLIDVTEVFRGISFEKKLRFTKLGFYIFLFIMVVFRLTLSAVYSFTEDDDLLHLF

SEQ ID NO: 617 - protein, 131 aa, Thellungiella halophila
MSVSLLTALAVLSLCSHTSTSEFQLSSISAAPSFLPEAPWSFSASPPAMSPDISPLFPTPGSREMSPSPSESSVMPTIPSSLSPPNPDAVSPDHLLDSSPAGSPLPASSSICLVSSPHSLLLVFLMLLLRF

SEQ ID NO: 618 - protein, 182 aa, Brassica rapa
  misc_feature (41)..(41): Xaa can be any naturally occurring amino acid
MRKLKNHEKKVLKKVNFLEWKREGGHRETLITGRYHMGGRXDYKKYSGLCRMVQKLTNVLKQMDATDPFRIQMTDMLLEKLYNMGVIPTRKSLALTDRLSVSSFCRRRLSTVLVHLKYAEHLTEAVTYIEQGHIRVGPDTITDPAFLVTRNMEDFITWVDSSKIKRKVLQYNDKLDDYDMLA

SEQ ID NO: 619 - protein, 182 aa, Brassica napus
MRKLKNHEKKVLKKVNFLEWKREGGHRETLITGRYHMGGRDDYKKYSGLCRMVQKLTNVLKQMDATDPFRIQMTDMLLEKLYNMGVIPTRKSLALTDRLSVSSFCRRRLSTVLVHLKYAEHLTEAVTYIEQGHIRVGPDTITDPAFLVTRNMEDFITWVDSSKIKRKVLQYNDKLDDYDMLA

SEQ ID NO: 620 - protein, 182 aa, Vigna unguiculata
MRKLKFHEKKLLKKVNFLEWKREGGHRENLVMQRHHITGRDDYKKYSGLCHMVQKLVNIVKQMDAKDPFRVDMTDKLLEKLYNMGVIPTRQSITLCERLTVSSFCRRRLSTVLVRLKFAEHLKEAVTYIEQGHIRVGPETVTDPAFLVTRNMEDFITWVDSSKIKRKVLQYNDKLDDYDLMN

SEQ ID NO: 621 - protein, 199 aa, Brassica rapa
AHSRQLTLPEFVLQGVEEFSENVAFVEAVTGKAVTYGDVVRDTKRLAKALTSLGLRKGQVMVVVLPNVAEYGIIALGIMSAGGVFSGANPTALVSEIKKQVEASGARGIITDSTNFEKVKALGLPVIVLGEEKIEGAVNWKDLLEAGDRSGDNNREKITSDRSMCTSLLFRHNRITKRSDAHTSQPHSKSLLYSLQRPV

SEQ ID NO: 622 - protein, 464 aa, Brassica napus
MVVVLPNVAEYGIIALGIMSAGGVFSGANPTALVSEIKKQVEASGASGIITDSTNFEKVKALGLPVIVLGEEKIEGAVNWKDLLEAGDRSGDNNREKILQTDLCALPFSSGTTGLQKGVMLTHRNLIANLCSTLFSVRSEMIGQIVTLGLIPFFHIYGIVGICCATMKNKGKVVAMSRYDLRLFLNALITHEVLFAPIVPPIILNLVKNPIVDEFDLSKLKLRSVMTAAAPLAPELLTAFEAKFPNVQVQEAYGLTEHSCITLTHGDPDKGQGIAKRNSVGFILPNLEVKFIDPDTGRSLPKNTSGELCVRSQCVMQGYFENKEETEKTIDEEGWLHTGDVGYIDDDGDIFIVDRIKELIKYKGFQVAPAELEAILLTHPSVEDVAVVPLPDEEAGEIPVACVVMNPKAKEKEEDILSFVAANVAHYKKIRAVHFVDSIPKSLSGKIMRRLLRDNILSIKKTLF

SEQ ID NO: 623 - protein, 222 aa, Arabidopsis thaliana
MQLIRGSTRLLQRHRFSISNTLPFTSSSCGSWSANESRKLGFDSFPSTRAATYLISSLKNAGFSSLAVVPKQNFSSRCFSTTGDSVQGSPESDCVVPQRIKFKRLDKTAKHIMQIVDKEAVEEVRTLREIPEIKPGYIVQLKVEVPENKRRVSIVKGVVIARRNAGLNSTFRIRRLVAGVGVESMFPLYSPNLRVIKVVDKKKVRRAKLYYLREKVNALKKH

SEQ ID NO: 624 - protein, 229 aa, Arabidopsis thaliana
MQSIRSSTRLLQRHRFSISNTLRFTSSSSSSGSWSENESRMVGFDSFPCTRAATYLISSLKNVGFSSSAIPKQDFKYSLRCFSTTGDSVQSTPQGSPESDCVVPQRIKFKRLDKTAKHIMQIVDKEAVEEVRNLREIPEIKPGYIVQLKVEVPENKRRVSIVKGVVIARRNAGLNSTFRIRRLVAGVGVESMFPLYSPNLREIKVVDKKKVRRAKLYYLRDKVNALKKH

SEQ ID NO: 625 - protein, 229 aa, Brassica napus
MQSICSSSTRLLQRNRFSISNTLLRFTSSSSPSWSENESRKLAGSDPFRSTRAFDSYLISSLTKAASFSSPVPKQCFTYSSRCFSTIGDSVPQGFPVVSAPDVPPRIKFKRLDKTAKHIMQIVDNEAVEEVRTRREIPEIRPGYIVQLKVEVPENKRRVSIVKGIVIARRNAGLNSTFRIRRLVAGVGVESMFPLYSPNLREIKVLDKKRVRRAKLYYLRDKMNALKKH

SEQ ID NO: 626 - protein, 110 aa, Raphanus sativus
MQIVDKEAVEEVRTSREIPEIRPGYIVQLKVEVPENKRRVSIVKGIVIARRNAGLNSTFRIRRLVAGVGVESMFPLYSPNLREIKVLDKKRVRRAKLYYLRDKMNALKKH

SEQ ID NO: 627 - protein, 231 aa, Raphanus sativus
MQSIRSTTRLLQRNRFSISNTLPRFTSSSSSPSWSDDNESRRPGGGFDSFRSTRAFDSPAASYLISSLTKAASFSSALPKQNFTYSSRCFSTVGDSVPQGFSPDAPPRIKFKRLDKTAKHIMQIVDKEAVEEVRTRREIPEIRPGYIVQLKVEVPENKRRVSIVKGIVIARRNAGLNSTFRIRRLVAGVGVESMFPLYSPNLREIKVLDKKRVRRAKLYYLRDKMNALKKH

SEQ ID NO: 628 - protein, 162 aa, Raphanus sativus
MDPSSASSVNGYYSFLNRSMDDLERVYLSNNFMSLHFLQRALCLLRTSHSHLTLLVQKLNLPVGDKWLDEYMDESSKLWEACLVIKSAVSSIENFSSAGISIASTLDGHYHHRRLSPQLSRQVIRAITGCRREAIGIEAENRALVENRVQSFRFGRSRRRRR

SEQ ID NO: 629 - protein, 271 aa, Brassica napus
ARTTFLCNSMEPAVTTTASSSFGGSPRLAALAQQLRMYKPPPSSSFDDDAEEMQADQESAGKVVSQVGFQESMTPVPKDPERFRPKRAAVLICIFEGEEGDLRVILTKRSSRLSTHSGEVSLPGGKAEEDDKDDGMTATREAEEEIGLDPSLVDIVTSLEPFLSKHLLRVIPVIGILKDKKSFNPKPNPAEVEAVFDAPLEMFLKDENRRSEEREWMGEKYLIHYFDYRTGDKDYTIWGLTAGILIRAASVTYQRPPAFIEQCPKFKYPKM

SEQ ID NO: 630 - protein, 289 aa, Raphanus sativus
MFLLHRRLPLLARTTFLCNSMEPALTASSSFGGSSRLAALAQQLRMYKPPPSSSSFENDDEETQADQESAGKVVSQVGFQESMTPVPKDPERFRPKRAAVLICIFEGDEGDLRVILTKRSSRLSTHSGEVSLPGGKAEEDDKDDGMTATREAEEEIGLDPSLVDVVTSLEPFLSKHLLRVIPVIGILKDKNTFNPKPNPAEVEAVFDAPLEMFLKDENRRSEEREWMGEKYLIHYFDYRTGDKDYTIWGLTAGILIRAASVTYQRPPAFTEQCPKFKYPKMVEKHTCMP

SEQ ID NO: 631 - protein, 51 aa, Raphanus sativus
MMTMTLAECISVAQDDEEWSALEGLTRVNSLLSIPRLFSGELRSTSWRKWL

SEQ ID NO: 632 - protein, 608 aa, Raphanus sativus
  misc_feature (151)..(151): Xaa can be any naturally occurring amino acid
  misc_feature (260)..(260): Xaa can be any naturally occurring amino acid
MLEVGSSNALFFQTNTTCNNLLRELQKIWVEIGESEAEKDGMLMELEKECLQIYQKKVEEAANSKARLHQSVAAIEAEVASLMAALGVLNINSQIKMDKSSKSLKEKLAAVTPLVEDLRIQKEERMKQFSDLKAQIEKISGEISGYSEHLXKGMISSLTLEEQDLTLRKLNEYQTHLRTLQKEKSDRLNKVLGYVNEVHTLCGVLGVDFSQTVCEVHPSLHRTDHEQSTNISDSTLEGLDNMIQKLKTERRARFQKLKDXVASLFELWNLMDTPHEERTKFGRVTYVVRSSESNVTEPGILSAETIEQVSTEVESLSKLKASKMKELVMKRRSELEDLCRLTHIQPDTSTSAEKSSALIDSGLVEPSELLANIEMEINKIKEEAQSRKDIMDRIDRWLSACEEENWLEEYNLDENRYSAGRGGHVNLKRAERARVTINKIPAMVDNLIKKTLVWEEETHKSFLYDGVRLVNILEDYKLTRKQQEEEKKRYRDQKKRQDLLLTQRESIYGSKPSPRRSSSFRKPSGYSISNGNGSMPPTPRRSSVGTTTPDLLLTPRSYSGHHRQNGYFKEVRRLASTPLNYVAIQKEDTASTTYTSIYSSEPDSPLQG

SEQ ID NO: 633 - protein, 520 aa, Arabidopsis thaliana
MANSKYEYVKSFELEDEVMLPNLMVVRIDGRDFSRFSQVHEFEKPNDETALNLMNSCSAAVLEEFPDIIFAYGYSDEYSFVFKKTSRFYQRRASKILSLVASFFAAVYVTKWKEFFPQRKLLYAPSFSSKVVSCASAEVLQAYLAWRQQDCHANNQYDTCFWMLVKSGKSVSETQEILKDTQKQQKNELLFQKFGINYKTLPELFRQGSCLFKKKVEETVKHDENGNPVKRLRRKAVFVHSENIAGRSFWNEQPSLYNDLGHFTKDIGKIEPDFIRSFQFENKLLPLTWVVVRIDGCHFHRFSDVHEFEKPNDEQALKLMNSCAVAVLEEFEDIHFAYGVSDEYSFVLKKESELYKRQSSKIISAVASFFTSTYVLQWGEFFPHKELKYPPSFDGRAVCYPTYNILLDYLAWRQVDCHINNQYNTCFWMLVKSGKNKTQSQDYLKGTQTREKNELLSRQFGIEYNSLPVIFRMGSSVFRLKEAENGVVSGKKLEGEVVVDHCNIIERCFWEEHLHILSYS

SEQ ID NO: 634 - protein, 493 aa, Brassica napus
  misc_feature (167)..(167): Xaa can be any naturally occurring amino acid
  misc_feature (181)..(181): Xaa can be any naturally occurring amino acid
  misc_feature (191)..(191): Xaa can be any naturally occurring amino acid
  misc_feature (199)..(199): Xaa can be any naturally occurring amino acid
MQTFSQLGPSEVFFIARRDNPCTRAQLWFTGRLPFRQESFGFRIKNRVEYSARPVPPNLIAAEKEEAKAVLTLFFKKQGLSNSVSVRIINKSDLFIDHLVSRLHSVHKARYLVGRELTTLEIRDSLIPYLEQLHEQHGDLLSDLVVSFPDPPPPAEDRPLSSSPPAXLAPPRGLTDSAADXKKLRAVSRVXELDTEGAXRPQTLYLLDLGLNLEQIKTITRKFAAFPYYSLEGKIKPVVEFLLDLGIPKSDIPTILCKRPQICGISLTDNLKPTMAFLETLGIDKNQWAKIIYRFPAILTYSRQKLISTVDFLTQTGLSEEQIGKILTRCPNIMSYSVEDKLRPTMEYFKSLNVDVAVLLHRCPQTFGLSIETNLKPVTEFFLEKGYCIDEIGIMISRYGALYTFSLRENLMPKWDYFQTMDYPKSELVKFPQFFGYSLQERIKPRYELVKRSGVRLLLNQVLSLSGVEFEKVVKKKMMKKLLSDHQSSSELL

SEQ ID NO: 635 - protein, 190 aa, Arabidopsis thaliana
MEHESKNKVDGMEMEKGKKESGSRKGLELTMRVLALVLTMVAATVLGVAKQTKVVPIKLIPTLPPLNVSTTAKASYLSAFVYNISANAIACGYTAISIVIVMISKGKRSKSLLMAVLIGDLMMVALLFSSTGAAGAIGLMGRHGNKHVMWKKVCGVFGKFCNQAAVSVAITLIASVVFMLLVVLDALKLP

SEQ ID NO: 636 - protein, 190 aa, Brassica rapa
MEQERKNNMNGMEMEKGKRESGSRKGLELTMRVLALVLTMVAATVLGVAKQTKVVSIKLIPTLPPLDVSTTAKASYLSAFVYNISANAIACGYAAISIAVLMICKGRRSKGLLMAVLIGDLVMVGLLFSGTGAAGAIGLMGSQGNKHVMWKKVCNVFGKFCHQAAASVAITLIASIVFMLLVVLDAMKLP

SEQ ID NO: 637 - protein, 190 aa, Brassica napus
MEHERKNNLNGMEMEKGNKESGSRKGLELTMRVLALVLSLTAATVLGVAKQTKVVSITLIPTLPPLDVSATAKASYLSAFVFNISANAIACGYTAISIAILMVSKGRRSKGLIMAVLIGDLVMMALLFSSTGAAGAIGLMGVQGNKHVMWKKVCNVFGKFCHQTAASVAITLLAAIMFMVLVVLDAMKLP

SEQ ID NO: 638 - protein, 190 aa, Brassica napus
MEQERKNNMNGMEIEKGKRESGSRKVLELTMRVLALVLTMVAATVLGVAKQTKVVSIKLIPTLPPLDVSTTAKASYLSAFVYNISANAIACGYTAISIAVLMICKGRRSKGLLMAVLIGDLVMVGLLFSGTGAAGAIGLMGSQGNKHVMWKKVCNVFGKFCHQAAASVAITLLASIVFMLLVVLDAMKLP

SEQ ID NO: 639 - protein, 190 aa, Brassica napus
MEQERKNNMNGMEMEKGKRESGSRKGLELTMRVLALVLTMVAATVLGVAKQTKVVSIKLIPTLPPLDVSTTAKASYLSAFVYNISANAIACGYASISIAVLMICKGRRSKGLLMAVLIGDLVMVGLLFSGTGAAGAIGLMGSQGNKHVMWKKVCNVFGKFCHQAAASVAITLLASIVFMLLVVLDAMKLP

SEQ ID NO: 640 - protein, 190 aa, Raphanus sativus
MEQERKNNMNGMEMEKGKRESGSRKGLELTMRVLALVLTMVAATVLGVAKQTKVVSIKLIPTLPPLDVSTTARASYLSAFVYNISANAIACGYAAISIAVLMICKGRRSKGLLVAVLVGDLVMVGLLFSGTGAAGAIGLMGSQGNKHVMWKKVCNVFGKFCHQAAASVAITLLASIVFMLLVVLDAMKLP

SEQ ID NO: 641 - protein, 190 aa, Raphanus sativus
MEHERKNNLNGMEMEKGKKESGSRKGLELTMRVLAWVLTLAAATVLGVAKQTKVVSITLIPTLPPLDVPATAKASYLSAFVFNISANAIACGYTAISIVILMISKERRSKGLIMAVLVGDLVMMALLFSGTGAAGAIGLMGVQGNKHVMWKKVCNVFGKFCHQTAASVAITLLAAIVFMVLVVLDAMKLP

SEQ ID NO: 642 - protein, 182 aa, Thellungiella halophila
MNGMEMEKGKKESGSRKGLELTMRVLALVLTLVAATVLGVSKQTKVVSIKVIPTLPPLDVSTTAKSTYLSAFVYNISANAIACGYTAISIVILIISKGRRSKGLLMAVLLGDLVMVALLFSGTGAAGAIGLMGLKGNKHVMWKKVCNVFGKFCHQAAASVAITFLSAVVFMVLVVLDAMKLP

SEQ ID NO: 643 - protein, 207 aa, Brassica oleracea
MAALASNPQMLTRQGHSSYKKEQFWKKESLSLEKKCGFCCVKVYNYEKLGRSQVEKEWRLEAFWSNVSQPETVEMVPINDVDELEAVLSEARNLSQPIIIEWMASWCRKCIYLKPKLEKLAAEYNNRTKFYYVDVNKVPQTLVKRGNISKMPTIQLWKEGEMQEEVIGGHKGWLVIEEVRELITNMFDSLFFSSSSFRLICTVTFKF

SEQ ID NO: 644 - protein, 187 aa, Brassica napus
MAALASNPQMLTRQGHSNYKKEQFWRKESLNLEKKCGFCCVKVYNYEKLGRSQVEKEWRLKAFWSNVSQPDTIEMVPINDVDELEAVLSDARNLSQPIIIEWMASWCRKCIYLKPKLEKLAAEYNNRTKFYYVDVNKVPQTLVKRGNISKMPTIQLWKEGEMQEEVIGGHKGWLVIEEVRELINKYV

SEQ ID NO: 645 - protein, 187 aa, Raphanus sativus
MAALASNPQMLTRQGHSNYKKEQFWRKESLNTEKKCGFFCVKVYNHEKLGRSQVEKEWRLKAFWSNVSQPETVEMVPINDVDELEAVLSDARNLSQPIIIEWMASWCRKCIYLKPKLEKLAAEYNNRTKFYYVDVNKVPQTLVKRGNISKMPTIQLWKEGEMQEEVIGGHKGWLVIEEVRELINKYV

SEQ ID NO: 646 - protein, 185 aa, Thellungiella halophila
MAALASNPQMLTRQGHSNYKKEQFWRKESLSLEKKCGFCVKVYSEKLGRSQIEKEWRLKAFWSNVSRPETVEMEPINDVDELDAVLSHARNLSQPIIIEWMASWCRKCIYLKPKLEKLAAEYNNRTKFYYVDVNKVPQTLVKRGNISKMPTIQLWKEDEMKEEVIGGHKGWLVIEEVRELINKYV

SEQ ID NO: 647 - protein, 580 aa, Brassica napus
  misc_feature (165)..(165): Xaa can be any naturally occurring amino acid
  misc_feature (280)..(280): Xaa can be any naturally occurring amino acid
  misc_feature (483)..(483): Xaa can be any naturally occurring amino acid
THHRRLDINLTELIQLFQSLVSIRSPNKKSLIDEIAESLMRMEFDEYEYLEKTVEEGDGLDRKKEESERSYRKREGERRDVEEGDEERRSSRSKKSRGDGEENGEGRRRDREKERHRSSRDKERERERDKIRVRGGSRDRESDRERSSKERDRGDRGKSRERERXKDRERRSKERERRSSSRSRREEKEREVVERGSRRNKDKKDEPEADPERDQRTVFAYQMPLKATERDVYEFFSKAGKVRDVRLIMDRNSRRSKGVGYVEFYDVMSVPMAIAMSGHXFLGQPVMVKPSEAEKNLAQSNATTGVVGGSGPSGPVDRKLYVGNLHYNMTELQLRQIFEQFGPIELVQMPYDLVSGQCKGYGFIQFAQFEHSKAAQTALNGQLEIAGRTIKVSFVSEHIGTQDANPKSADFDDDDGNGLALNAQTRVQLMQKLDRTGVAANIVGPFGVPALNGTALNQPGMNPGFPTSVLPTTAIPAFVTEPXGQPSQCLLLKNMFDPATETELDFDEEIKDDVGQECSKYGQVNHIYVDKKSAGFVYLRFESVQAAAAAQRAMHMRWFAQKMISATFMPPNEYEAKAKA

SEQ ID NO: 648 - protein, 212 aa, Brassica juncea
MWSVTGALGVAVPTAAACRPKPFITSSNLLPKQTKKLHLSPQQQPLSLASQFSSSSFRTAASSVEQQSDNKGESTKYYFLVANAKFMLDEEEHFQEQLFERLRYYGENDKELDFWLVIEPKFLDKFPKITQRLRRPAVALVSTNGPWITFMKLRLDRVLADSFEATSLDEALAFTPTTLEFDKPKNWVAPYPKYEPGWWETFLPKAKQESVA

SEQ ID NO: 649 - protein, 213 aa, Brassica oleracea
  misc_feature (200)..(200): Xaa can be any naturally occurring amino acid
MWSVTGALCVAVPTAAAFRPKPFLVSSNLLPNQTKKLHLSPPQPPALSSHFSSSSFKTAATSVQQQSDDKKGEKSTKYYFLVANAKFMLDEEEHFQEQLFERLKYYGERDKEKDFWLVIEPKFLDKFPKLTQRLRRPAVALVSTNGPWITFMKLRLDRVLADSFEAASLDEALASSPTTLEFDQPGNWVAPYPKYEPGWXDTFLPKAKQESVA

SEQ ID NO: 650 - protein, 210 aa, Brassica oleracea
MWSVTGALGVAVPTAAACRPKHLLTSSNLLPKQTKKLHLYPQQPLSLASHFSSSFRTAASSVEQQSDNKGESTKYYFVVANAKFMLDEEEHFQEQLFERLRYYGENEKELDFWLVIEPKFLDKFPKITQRLRRPAVALVSTNGPWITFMKLRLDRVLADSFEATSLDEALAFTPTTLEFDKPKNWVAPYPKYEPGWWETFLPKIKQESVA

SEQ ID NO: 651 - protein, 212 aa, Brassica rapa
MWSVTGALGVAVPTAAACRTKPLLVSSNLLPKQTKKLHLSPQQQPLSLASQFSSSSFRTAATSVEQQSDNKGESTKYYFLVANAKFMLDEEEHFQEQLFERLRYYGENEKELDFWLVIEPKFLDKFPKITQRLRRPAVALVSTNGPWITFMKLRLDRVLADSFEATSLDEALAFTPTTLEFDKPKNWVAPYPKYEPGWWETFLPKAKQESVA

SEQ ID NO: 652 - protein, 210 aa, Brassica napus
MWSVTGALGVVVPTAAACRPKHLLTSSNLLPKQTKKLHLYPQQPLSLASHFSSSFRTAASSVEQQSDNKGESTKYYFVVANAKFMLDEEEHFQEQLFERLRYYGENEKELDFWLVIEPKFLDKFPKITQRLRRPAVALVSTNGPWITFMKLRLDRVLADSFEATSLDEALAFTPTTLEFDKPKNWVAPYPKYEPGWWETFLPKIKQESVA

SEQ ID NO: 653 - protein, 213 aa, Brassica napus
MWSVTGALSVAVPTAAAFRPKPFLVSSNLLPNQTKKLHLSPPQTPALSSHFSSSSFKTAATSVQQQSDDKKGEKSTKYYFLVANAKFMLDEEEHFQEQLFERLRYYGERDKEQDFWLVVEPKFLDKFPKLTQRLRRPAVALVSTNGPWITFMKLRLDRVLADSFEAASLDEALDSSPTTLEFDQPGNWVAPYPKYEPGWWDTFLPKAKQESVA

SEQ ID NO: 654 - protein, 212 aa, Brassica napus
MWSVTGALGVAVPTAAACRPKPFITSSNLLPKQTKKLHLSPQQQPLSLASQFSSSSFRTAASSVEQQSDNKGESTKYYFLVANAKFMLDEEEHFQEQLFERLRYYGENEKELDFWLVIEPKFLEKFPKITQRLRRPAVALVSTNGPWITFMKLRLDRVLADSFEATSLDEALAFTPTTLEFDKPKNWVAPYPKYEPGWWETFLPKAKQESVA

SEQ ID NO: 655 - protein, 214 aa, Raphanus sativus
MWSVTGALGVAVPTAAACRTKPLLFSSTLLPKQTNKLHLSPQQQQPLSLSSHFSSSSFITAATSSVEQQSDNKGVSSKYYFLVANAKFMLDEEEHFQEQLFERLRYYGENEKELDFWLVIEPKFLDKFPKITQRLRRPAVALVSTNGPWITFMKLRLDRVLADSFEATSLDEALAFTPTTLEFDKPKNWVAPYPKYEPGWWETFLPKAKQESLA

SEQ ID NO: 656 - protein, 210 aa, Raphanus sativus
MWSVTGALGVAVPTAAACRTKPLLVSSTLLPKQTNKLHLSPQQQPLSLSSHLSSFITAATSVEQQSDNKGESSKYYFLVANAKFMLDEEEHFQEQLFERLRYYGENEKELDFWLVIEPKFLDKFPNITQRLRRPAVALVSTNGPWITFMKLRLDRVLADSFEATSLDEALAFTPTSLEFDKPKNWVAPYPKYEPGWWETFLPKAKQESLA

SEQ ID NO: 657 - protein, 212 aa, Raphanus sativus
  misc_feature (17)..(17): Xaa can be any naturally occurring amino acid
  misc_feature (42)..(42): Xaa can be any naturally occurring amino acid
MWSVTGAFGVVAVPTAXACRTKPLLVSSTLLPKQTNKLHLSXQPLSLSSHFSSSSFITAATSVEQQSDNKGESSSKYYFLVANAKFMLDEEEHFQEQLFERLRYYGENEKELDFWLVIEPKFLDKFPNITQRLRRPAVALVSTNGPWITFMKLRLDRVLADSFEATSLDEALAFTPTTLEFDKPKNWVAPYPKYEPGWWETFLPKAKQESLA

SEQ ID NO: 658 - protein, 213 aa, Raphanus sativus
MWSVTGALGVAVPTAAACRTKPLLVSSTLLPKQTNKLHLSPQQQQPLSLSSHFSSSSFITAATSVEQQSDNKGESSKYYFLVANAKFMLDEEEHFQEQLFERLRYYGENEKELDFWLVIEPKFLDKFPNITQRLRRPAVALVSTNGPWITFMKLRLDRVLADSFEATSLDEALAFTPTTLEFDKPKNWVAPYPKYEPGWWETFLPKAKQESLA

SEQ ID NO: 659 - protein, 126 aa, Thellungiella halophila
MLDEEEHFQEQLFERLRYYGEREKEQDFWLVIEPKFLDKFPKITQRLRRPAVALVSTNGPWITFMKLRLDRVLAESFEAKSLDEALASNPATLEFDQPEKWVAPYPKYESGWWETFLPKEIQESVV

SEQ ID NO: 660 - protein, 350 aa, Arabidopsis thaliana
MASFILSRSLLVLLLSLTALLSSISISEATSSFSFTSSGKNASFESEDFALYGDAKLVDGGSSIQLTDSVSHGGGRVIYKKPIESMNNIKFEYFTGFSTFFSFSISPSRGGRLGFVVFPVNETFDHSLFQVKFDTFDSFTQIGDSNVAVIVDGATVSERIRNFTIANLEKTEKVLLYAWINYQAGGKFLEVRLSKSKSFESVLPLMFDQIDLSQMLRDEDEFMVAVNSYSGNVNLHSWSLEVRHSEYEHSWAPVLLEEQLRKEEQLRKEEAAKKRTSDRMWEVVTCFVMTFGSTGLVFFAMMHIYAAFKRNNLAMVMQEECGIKTKEFGYKKMEKMEVVTSNADAKQERK

SEQ ID NO: 661 - protein, 78 aa, Arabidopsis thaliana
MGFWTLLKGLLLFANALAILNEDRFLVPRGWTLGELHQTDRRNSPKGQIIGLIHACQYMRLPLMLINTAVIVLKLISG

SEQ ID NO: 662 - protein, 97 aa, Brassica juncea
IFNEISPTLQPPFDSPRDIMGFWTLMEGLLLFANALAILNEDRFLAPKGWTLAELHQTGKRNSLKGQIVGLIHACQYMRLPLMLFNLIVIVVKLFSG

SEQ ID NO: 663 - protein, 72 aa, Brassica juncea
IIMGFWTLMEGLLLFANALAILNEDRFLAPKGWTLAELHQTGKRNSLKGQIVGLIHACQYMRLPLMLFNLIV

SEQ ID NO: 664 - protein, 78 aa, Brassica oleracea
MGFWTLMEGLLLFANALAILNEDRFLAPKGWTLAELHQTGKRNSLKGQIVGLIHACQYMRLPLMLFNLIVIVVKLFSG

SEQ ID NO: 665 - protein, 78 aa, Brassica oleracea
MGFWTLMEGLLLFANALAIPNEDRFLAPRGWTLTELHQTGKRNSLKGQIVGLIHACHYMRLPLMLFNLIVIVFKLFSG

SEQ ID NO: 666 - protein, 78 aa, Brassica rapa
MGFWTLMEGLLLFANALAILNEDRFLAPRGWTLTELHQTGKRNSLKGQIVGLIHACHYMRLPLMLFNLIVIVFKLFSG

SEQ ID NO: 667 - protein, 78 aa, Brassica napus; identical to SEQ ID NO: 664

SEQ ID NO: 668 - protein, 199 aa, Brassica napus
MGMVFGKISVETPKYTVVKSCDGYEIREYPPAVAAEITYDPSEFKDNRDGGFTVLAKYIGVFGKPENQKPEKIAMTAPVITKEGEKIAMTAPVVTKEEGGEKKTVTMQFLLPEVYKKAEDAPRPTDERVVIKEEGGRKYGVVTFGGNAAESVVGEKVKKLRSDLERDGFKITGDYVLARYNPPWTLPPFKTNEVMIPVE

SEQ ID NO: 669 - protein, 105 aa, Brassica napus
NCRFAGFVIFNEISPTRQPPVDSPRDIMGFWTLMEGLLLFANALAILNEDRFLAPKGWTLAELHQTGKRNSLKGQIVGLIHACQYMRLPLMLFNLIVIVVKLFSG

SEQ ID NO: 670 - protein, 78 aa, Brassica napus
MGFWTLMEGLLLFANALAILNEDRFLAPKGWTLAELHQTGKRNSLKGQIVGLIHACQYMRLPLMLFNLIVIVFKLFSG

SEQ ID NO: 671 - protein, 78 aa, Brassica napus; identical to SEQ ID NO: 670

SEQ ID NO: 672 - protein, 78 aa, Brassica napus; identical to SEQ ID NO: 670

SEQ ID NO: 673 - protein, 112 aa, Raphanus sativus
KDNCRLRHLQRTRSVLTLEPRLDFDSPRERERETMGFWTLLEGLLLFANALAILNEDRFLAPKGWTLAELHQTGKRNSLKGQIVGLIHACQYMRLPLMLFNLIVIVFKLFSG

SEQ ID NO: 674 - protein, 78 aa, Raphanus sativus
  misc_feature (41)..(41): Xaa can be any naturally occurring amino acid
MGFWTLMEGLLLFANALAILNEDRFLAPKGWTLAELHQTGXRNSLKGQIVGLIHACQYMRLPLMLFNLIVIVFKLFSG

SEQ ID NO: 675 - protein, 239 aa, Brassica rapa
SSTSSLCSKPEQIMQNPPPIISSPRFLQPQTRSLPHHEQHQHLSNPYPTTFVQADTSTFKQVVQMLTGSSSTDTNTGKHHEAPSPVNNNKGGFSIPPIKKTNSFKLYERRQNNNNNMFAKNDLMINTLRLQNSQRLMFSSGNNVHQSPRFSPRNSSSENVLLSPSMLDFPKLGLNSPVTPLRSNNDPFNKSSPLSLGSSSEEDKAIAEKGYFLHPSPVSPPRDSQPLLLPLFRVLLEDP

SEQ ID NO: 676 - protein, 274 aa, Raphanus sativus
  misc_feature (64)..(64): Xaa can be any naturally occurring amino acid
  misc_feature (194)..(194): Xaa can be any naturally occurring amino acid
  misc_feature (270)..(270): Xaa can be any naturally occurring amino acid
DINNFQSSSYSLSIIPSFFLPSYTHRRVSLMEVSSTSSPCSKPEQIMPNSPPLISSPKFQHQMXRSPHHDQHQHLSNPYPTTFVQADTSTFKQVVQMLTGSSSTDTNTEKHHEAPSPSPVNNSKGGFSIPPIKKTNSFKLYERRQNNNNNMFAKNDLMINTLRLQNSQRLMFSSGNNVHQSPRFSPRDNSSENXLLSPSMLDFPKLGLNSPVTPLRSNNDPFNKSSPLSLGSSSEEDKAIAEKGYYLHPSPVSTPRDFQPLLLPLFPVTXPRNL

SEQ ID NO: 677 - protein, 503 aa, Arabidopsis thaliana
MSTLEDGFPADKLFAQGYSYTYDDVIFLPHFIDFSTDAVSLSTRLSRRVPLSIPCVSSPMDTVSESHMAAAMASLGGIGIVHYNCGIAAQASIIRQAKSLKHPIASDAGVKFPEYEITSLDAFGPSSFVFVEQTGTMTTPKLLGYVTKSQWKRMNYEQREMKIYDYMKSCDSSDYCVPWEIDFEKLEFVLEDKQKGFVVLERDGETVNVVTKDDIQRVKGYPKSGPGTVGPDGEWMVGAAIGTRESDKERLEHLVNVGVNAVVLDSSQGNSIYQLEMIKYVKKTYPELDVIGGNVVTMYQAQNLIQAGVDGLRVGMGSGSICTTQEVCAVGRGQATAVYKVCSIAAQSGIPVIADGGISNSGHIVKALVLGASTVMMGSFLAGSTEAPGGYEYTNGKRIKKYRGMGSLEAMTKGSDQRYLGDQTKLKIAQGVVGAVADKGSVLKLIPYTMHAVKQGFQDLGASSLQSAHGLLRSNILRLEARTGAAQVEGGVHGLVSYEKKSF

SEQ ID NO: 678 - protein, 503 aa, Brassica napus
  misc_feature (212)..(212): Xaa can be any naturally occurring amino acid
  misc_feature (231)..(231): Xaa can be any naturally occurring amino acid
MTSFEDGFPAEKLFSQGYSYTYDDVIFLPHYIDFSTDAVSLSTRLSRRVPLSIPCVSSPMDTVSESHMAAAMASLGGIGIVHYNSDIAAQASVIRQAKSLRHPIASDAGVKLPEYEITSLDAFGPSSFVFVTQSGTMTVPKLLGYVTKAQWKKMNYEQREMKIHDYMKSCEGSEYCLPWDIDIEKIEALLEDKQKGFVVLERDGETVNVVTXDDIERVRGYPKSGPGTVGXDGEWMVGAAIGTRESDKERLEHLVKAGANVVVLDSSQGNSIYQLEMIKYVKKSYPELDVIGGNVVTSYQAQNLIQAGVDGLRVGMGSGSICTTQEVCAVGRGQATAVYKVCSLAAQSGIPVIADGGISNSGHIVKALVLGASTVMMGSFLAGSTEAPGSYEYKNGKRIKKYRGMGSLEAMTKGSDQRYLGDKTNLKIAQGVVGAVADKGSVLKLIPYTMHAVKQGFQDLGASSLQSAHDLLRSNVLRLETRTGAAQIEGGVHGLVSYEKKSF

SEQ ID NO: 679 - protein, 268 aa, Brassica napus
MVGAAIGTRESDKERLEHLVKAGANVVVLDSSQGNSIYQIEMIKYVKNLYPELDVVGGNVVTMYQAENLIKAGVDGLRVGMGSGSICTTQEVCAVGRGQATAVYKVSTLAAQHGVPVIADGGISNSGHIVKALVLGASTVMMGSFLAGSTEAPGAYEYRNGRRVKKYRGMGSLEAMTKGSDQRYLGDTAKLKIAQGVVGAVADKGSVLKFIPYTMHAVKQGFQDLGASSLQSAHELLRENVLRLEARTGAAQIEGGVHGLVSYEKKSF

SEQ ID NO: 680 - protein, 347 aa, Raphanus sativus
  misc_feature (75)..(75): Xaa can be any naturally occurring amino acid
MGSLVKEGASSSLMTEFLEKCGGYAVVDGGFATELERHGADIKDPLWSAKCLITSPHLVTKVHLDYLESGANIIXTASYQATIQGFVAKGLSVDDAESLLRRSVELSCEAREIFYNRCNKGSWDFDHVGKASRRPVLVAASVGSYGAYLADGSEYSGVYGEYVSKETLKDFHRRRVQILAKSGADLIAFETIPNKLEAEAYVDLLEEEGIDIPAWFSFTSKDGVTVPSGESIIECAKVADSCKKAVAIGINCTAPRYIHDLIISLRQVTRKPIIVYPNSGEVYDGLNKKWIQSEEEAEEDFVSYVSRWKEEGASLFGGCCRTTPNTIRAIAKVLSCESPTPSKLKFW

SEQ ID NO: 681 - protein, 340 aa, Brassica oleracea
  misc_feature (296)..(296): Xaa can be any naturally occurring amino acid
  misc_feature (332)..(332): Xaa can be any naturally occurring amino acid
MTKKNNNNNEEEEFVSFGHNLNTKIRFEDADEDEVAEGSGLEAAQDESMCEAGESTDAAEVTDDTTSADYYFDSYSHFGIHEEMLKDVVRTKTYQNVIYQNKFLIKDKIVLDVGAGTGILSLFCAKAGAKHVYAVECSQMADMAKEIVKANGFSDVITVLKGKIEEIELPTPKVDVIISEWMGYFLLFENMLDSVLYARNKWLVDGGIVLPDKASLFLTAIEDSEYKEDKIEFWNSVYGFDMSCIKKKAMMEPLVDTVDQKQIVTDSRLLKTMDISKMSSGDASFTAPFKLVAQRXDYIHALVAYFDVSFTMCHKLLGFSQDRSHGPRTGNXQSCTLKMC

SEQ ID NO: 682 - protein, 390 aa, Brassica rapa
MTKKNNNNNNEEEEFVSFGHNLNTKIRFEDADEDEVAEGSGFEAAQDESMCEAGESTDAAQVTDDTTSADYYFDSYSHFGIHEEMLKDVVRTKTYQNVIYQNKFLIKDKIVLDVGAGTGILSLFCAKAGAKHVYAVECSQMADMAKEIVKANGFSDVITVLKGKIEEIELPTPKVDVIISEWMGYFLLFENMLDSVLYARNKWLVDGGIVLPDKASLFLTAIEDSEYKEDKIEFWNSVYGFDMSCIKKKAMMEPLVDTVDQNQIVTDSKLLKTMDISKMSSGDASFTAPFKLVAQRNDYIHALVAYFDVSFTMCHKLLGFSTGPRSRATHWKQTVMYLEDVLTICEGETITGSMSVSYNKKNPRDVDIKLSYSLNGQHSKVSRTQHYKMR

SEQ ID NO: 683 - protein, 389 aa, Brassica napus
  misc_feature (267)..(267): Xaa can be any naturally occurring amino acid
MTKKNNNNNEEEEEFVSFGHNLNTKIRFEDADEDETAQGSAEAATAQDEPMCDAADITTDAADDTTSADYYFDSYSHFGIHEEMLKDVVRTKTYQNVIYQNKFLIKDKVVLDVGAGTGILSLFCAKAGAKHVYAVECSQMADMAKEIVKANGFSDVITVLKGKIEEIELPTPKVDVIISEWMGYFLLFENMLDSVLYARNKWLVDGGIVLPDKASLFLTAIEDSEYKEDKIEFWNSVYGFDMSCIKKKAMMEPLVDTVDQKQIVTDXRLLKTMDISKMSSGDASFTAPFKLVAQRNDYIHALVAYFDVSFTMCHKLLGFSTGPKSRATHWKQTVMYLEDVLTICEGETITGSMSVSYNKKNPRDIDIKLSYSLDGQHSKVSRTQHYKMR

SEQ ID NO: 684 - protein, 390 aa, Brassica napus
  misc_feature (42)..(42): Xaa can be any naturally occurring amino acid
MTKKNNNNNNEEEEFVSFGHNLNTKIRFEDADEDEVAEGSGXEAAQDESMCEAGESTDAAQVTDDTTSADYYFDSYSHFGIHEEMLKDVVRTKTYQNVIYQNKFLIKDKIVLDVGAGTGILSLFCAKAGAKHVYAVECSQMADMAKEIVKANGFSDVITVLKGKIEEIELPTPKVDVIISEWMGYFLLFENMLDSVLYARNKWLVDGGIVLPDKASLFLTAIEDSEYKEDKIEFWNSVYGFDMSCIKKKAMMEPLVDTVDQNQIVTDSKLLKTMDISKMSSGDASFTAPFKLVAQRNDYIHALVAYFDVSFTMCHKLLGFSTGPRSRATHWKQTVMYLEDVLTICEGETITGSMSVSYNKKNPRDVDIKLSYSLNGQHSKVSRTQHYKMR

SEQ ID NO: 685 - protein, 362 aa, Zea mays
MTKNSNHDENEFISFEPNQNTKIRFEDADEDEVAEGSGVAGEETPQDESMFDAGESADTAEVTDDTTSADYYFDSYSHFGIHEEMLKDVVRTKTYQNVIYQNKFLIKDKIVLDVGAGTGILSLFCAKAGAAHVYAVECSQMADMAKEIVKANGFSDVITVLKGKIEEIELPTPKVDVIISEWMGYFLLFENMLDSVLYARDKWLVEGGVVLPDKASLHLTAIEDSEYKEDKIEFWNSVYGFDMSCIKKKAMMEPLVDTVDQNQIVTDSRLLKTMDISKMSSGDASFTAPFKLVAQRNDYIHALVAYFDVSFTMCHKLLGFSTGPKSRATHWKQTVLYLEDVLTICEGETITGTMSVSPNKKN

SEQ ID NO: 686 - protein, 388 aa, Raphanus sativus
MTKNNNHNEEEEFISFGHNLNTKIRFEDADEDEVAEGSGLEAGQDESMCDAGESNDAAEVTDDTTSADYYFDSYSHFGIHEEMLKDVVRTKTYQNVIYQNKFLIKDKIVLDVGAGTGILSLFCAKAGAKHVYAVECSQMADMAKEIVKANGFSDVITVLKGKIEEIELPTPKVDVIISEWMGYFLLFENMLDSVLYARNKWLVDGGIVLPDKASLFLTAIEDSEYKEDKIEFWNSVYGFDMSCIKKKAMMEPLVDTVDQNQIVTDSKLLKTMDISKMSSGDASFTAPFKLVAQRNDYIHALVAYFDVSFTMCHKLLGFSTGPRSRATHWKQTVMYLEDVLTICEGETITGSMSVSYNKKNPRDVDIKLSYSLNGQHSKVSRTQHYKMR

SEQ ID NO: 687 - protein, 277 aa, Thellungiella halophila
MLELGQESCLCSVPRQEQLMYTLECSQMADMAKEIVKANGFSDVITVLKGKIEEIELPTPKVDVIISEWMGYFLLFENMLDSVLYARDKWLVDGGIVLPDKASLFLTAIEDSEYKEDKIEFWNSVYGFDMSCIKKKAMMEPLVDTVDQNQIVTDSRLLKTMDISKMSSGDASFTAPFKLVAQRNDYIHALVAYFDVSFTMCHKLLGFSTGPRSRATHWKQTVMYLEDVLTICEGETITGSMSVSYNKKNPRDVDIKLSYSLDGQHSKISKTQHYKMR

SEQ ID NO: 688 - protein, 500 aa, Arabidopsis thaliana
MEGQTLIFTFLFISLSLTFIIGRIKRRPNLPPSPSWALPVIGHLRLLKPPLHRVFLSVSESLGDAPIISLRLGNRLVFVVSSHSLAEECFTKNDVVLANRFNSLASKHISYGCTTVVTASYGDHWRNLRRIGAVEIFSAHRLNSFSSIRRDEIHRLIACLSRNSSLEFTKVEMKSMFSNLTFNNIIRMLAGKCYYGDGAEDDPEAKRVRELIAEGMGCFGAGNTADYLPILTWITGSEKRIKKIASRLDEFLQGLVDERREGKEKRQNTMVDHLLCLQETQPEYYTDNIIKGIMLSLILAGTDTSAVTLEWTLSALLNHPQILSKARDEIDNKVGLNRLVEESDLSHLPYLQNIVSESLRLYPASPLLVPHVASEDCKVGGYHMPRGTMLLTNAWAIHRDPKIWDDPTSFKPERFEKEGEAQKLLGFGLGRRACPGSGLAQRLASLTIGSLIQCFEWERIGEEEVDMTEGGGGVIMPKAIPLVAMCKARPVVGKILNESA

SEQ ID NO: 689 - protein, 1233 aa, Arabidopsis thaliana
MQPSGDPAPEKEKEMTQPKVSLLKLFSFADFYDCVLMTLGSVGACIHGASVPIFFIFFGKLINIIGLAYLFPKQASHRVAKYSLDFVYLSVAILFSSWLEVACWMHTGERQAAKMRRAYLRSMLSQDISLFDTEASTGEVISAITSDILVVQDALSEKVGNFLHYISRFIAGFAIGFTSVWQISLVTLSIVPLIALAGGIYAFVAIGLIARVRKSYIKAGEIAEEVIGNVRTVQAFTGEERAVRLYREALENTYKYGRKAGLTKGLGLGSMHCVLFLSWALLVWFTSVVVHKDIADGGKSFTTMLNVVIAGLSLGQAAPDISAFVRAKAAAYPIFKMIERNTVTKTSAKSGRKLGKVDGHIQFKDATFSYPSRPDVVIFDRLNLAIPAGKIVALVGGSGSGKSTVISLIERFYEPISGAVLLDGNNISELDIKWLRGQIGLVNQEPALFATTIRENILYGKDDATAEEITRAAKLSEAISFINNLPEGFETQVGERGIQLSGGQKQRIAISRAIVKNPSILLLDEATSALDAESEKSVQEALDRVMVGRTTVVVAHRLSTVRNADIIAVVHEGKIVEFGNHENLISNPDGAYSSLLRLQETASLQRNPSLNRTLSRPHSIKYSRELSRTRSSFCSERESVTRPDGADPSKKVKVTVGRLYSMIRPDWMYGVCGTICAFIAGSQMPLFALGVSQALVSYYSGWDETQKEIKKIAILFCCASVITLIVYTIEHICFGTMGERLTLRVRENMFRAILKNEIGWFDEVDNTSSMLASRLESDATLLKTIVVDRSTILLQNLGLVVTSFIIAFILNWRLTLVVLATYPLVISGHISEKLFMQGYGGDLNKAYLKANMLAGESVSNIRTVAAFCAEEKILELYSRELLEPSKSSFRRGQIAGLFYGVSQFFIFSSYGLALWYGSTLMDKGLAGFKSVMKTFMVLIVTALAMGETLALAPDLLKGNQMVASVFEILDRKTQIVGETSEELNNVEGTIELKGVHFSYPSRPDVVIFRDFDLIVRAGKSMALVGQSGSGKSSVISLILRFYDPTAGKVMIEGKDIKKLDLKALRKHIGLVQQEPALFATTIYENILYGNEGASQSEVVESAMLANAHSFITSLPEGYSTKVGERGVQMSGGQRQRIAIARAILKNPAILLLDEATSALDVESERVVQQALDRLMANRTTVVVAHRLSTIKNADTISVLHGGKIVEQGSHRKLVLNKSGPYFKLISLQQQQQP

SEQ ID NO: 690 - protein, 1250 aa, Populus trichocarpa
MSSLAGNIEDTDDVEKKKEEKKKQRKVPFWKLFAFADFYDYVLMGLGSLGACVHGASVPVFFIFFGKLINIIGLAYLFPKEASHRVGKYSLDFVYLSVVILFASWIEVACWMHTGERQAAKMRMAYLKSMLSQDISLFDTEASTGEVIAAITSDIIVVQDAISEKVGNFMHYISRFLGGFIIGFVRIWQISLVTLSIVPLIALAGGIYAYITIGLIAKVRKSYVKASQVAEEVIGNVRTVQAFTGEEKAVRSYIEALRKTYKYGRKAGLAKGLGLGTLHCVLFLSWALLVWYTSIVVHKNIANGGESFTTMLNVVISGLSLGMAAPDISSFLHATAAAYPIFEMIEKNTMSKISSESGRKVDRVDGHIEFKDVCFRYPSRPDVTIFDKFCLDIPSGKIVALVGGSGSGKSTVISLIERFYDPLFGKILLDGNDIRDLDLKWLRQQIGLVNQEPALFATSIRENILYGKDDATLEEITRAAKLSGAMSFINNLPDKFETQVGERGIQLSGGQKQRIALSRAIVKNPSILLLDEATSALDAESEKSVQEAIDRAIVGRTTVVVAHRLSTIRNADVIAVVQEGKIVEIGSHEELISNPQSTYASLVHLQEAASLQRHPSHGPTLGRPLSMKYSRELSHTRSSFGTSFHSDKDSVSRVGGDALESTRTKNVSLKRLYSMVGPDWIYGVLGTMGAFIAGSAMPLFALGVSQALVAYYMDWDTTRHEVKKIAILFCCGAAISVIVYAIEHLSFGIMGERLTLRVREMMFSAILKNEIGWFDDLNNTSSMLTSRLESDATLLRTIVVDRSTILLQNVGLVVTSFIIAFTLNWRITLVVIATYPLIISGHISEKLFMKGYGGNLSKAYLKANMLAGEAVSNIRTVAAFCAEEKILDLYARELVEPSKNSFTRGQIAGIFYGICQFFIFSSYGLALWYGSVLMEKELAGFKSIMKSFMVLIVTALAMGETLALAPDLLKGNHMAASVFEILDRKTQVMGDVGEELKNVEGTIELRGVQFSYPSRPDALIFKDFDLRVRSGKSMALVGQSGSGKSSVLSLILRFYDPTAGKVMIDGIDIKELKVKSLRKHIGLVQQEPALFATSIYENILYGKEGASEAEVIEAAKLANAHSFISSLPEGYSTKVGERGVQLSGGQKQRVAIARAVLKNPEILLLDEATSALDVESERIVQQALDRLMRNRTTVVVAHRLSTIKNADQISIIQEGKIIEQGTHSSLVENKDGAYFKLVRLQQQGGVEQNH

SEQ ID NO: 691 - protein, 1242 aa, Glycine max
GTLSGDSAVDDAKSNKKEHKVSLLKLFSFADFYDYVLMGVGSVGAIVHGASVPVFFIFFGKLINVIGLAYLFPKEASHKVAKYSLDFVYLSIAILFSSWTEVACWMHTGERQAAKMRMAYLKSMLNQDISLFDTEASTGEVISSITSDIIIVQDALSEKVGNFMHYISRFVAGFVIGFVRVWQISLVTLSIVPLIALAGGLYAYVTIGLIAKVRKAYVRAGEIAEEVIGNVRTVQAFAGEERAVRSYKAALMKTYVNGRKAGLAKGLGLGSMHCVLFLSWSLLVWFTSIVVHKNIANGGESFTTMLNVVIAGLSLGQAAPDISAFIRAKAAAYPIFEMIERDTVSKSSSKTGRKLGKLEGHIQFKNICFSYPSRPDVAIFNNLCLDIPSGKIVALVGGSGSGKSTVISLIERFYEPLSGQILLDRNDIRELDLKWLRQQIGLVNQEPALFATSIKENILYGKDDATLEELKRAVKLSDAQSFINNLPDRLETQVGERGIQLSGGQKQRIAISRAIVKNPSILLLDEATSALDAESEKSVQEALDRVMVGRTTVVVAHRLSTIRNADMIAVVQGGKIVETGNHEELMANPTSVYASLVQLQEAASLHRLPSIGPSMGRQPSITYSRELSRTTTSLGGSFRSDKESIGRVCAEETENAGKKRHVSAARLYSMVGPDWFYGVAGTLCAFIAGAQMPLFALGISHALVSYYMDWETTCHEVKKIAFLFCGAAVITVTVHAIEHLSFGIMGERLTLRVREMMFSAILKNEIGWFDDTNNTSSMLSSQLETDATLLRTIVVDRSTILLQNIGLVVASFIVAFILNWRITLVVIATYPLIISGHISEKLFMKGYGGNLSKAYLKANMLAGEAVSNIRTVAAFCSEEKVLDLYANELVDPSKRSLQRGQIAGIFYGISQFFIFSSYGLALWYGSVLMEKELASFKSIMKAFFVLIVTALAMGETLALAPDLLKGNQMVASVFEVMDRKSGISCEVGEELKTVDGTIELKRINFSYPSRPDVIIFKDFNLRVPAGKSVALVGQSGSGKSSVISLILRFYDPTSGRVLIDGKDITRLNLKSLRRHIGLVQQEPALFATSIYENILYGKEGASDSEVIEAAKLANAHNFISGLPEGYSTKVGERGVQLSGGQRQRVAIARAVLKNPEILLLDEATSALDVESERIVQQALDRLMQNRTTVMVAHRLSTIRNADQISVLQDGKIIDQGTHSSLIENKNGAYYKLVNLQQQQHQL

SEQ ID NO: 692 - protein, 1241 aa, Glycine max
GTLSGDSAMDDAKSNKKEHKVSLLKLFSFADFYDYVLMGVGSVGAIVHGASVPVFFIFFGKLINVIGLAYLFPKEASHKVAKYSLDFVYLSIAILFSSWTEVACWMHTGERQAAKMRMAYLKSMLNQDISLFDTEASTGEVISAITSDIIIVQDALSEKVGNFMHYISRFVAGFVIGFVRVWQISLVTLSIVPLIALAGGLYAYVTIGLIAKVRKAYVRAGEIAEEVIGNVRTVQAFAGEERAVRSYKAALMKTYVNGRKAGLAKGLGLGSMHCVLFLSWSLLVWFTSIVVHKNIANGGESFTTMLNVVIAGLSLGQAAPDISAFIRAKAAAYPIFEMIERETVSKSSSKTGRKLGKLEGHIQFKNVCFSYPSRPDVAIFNNLCLDIPSGKIIALVGGSGSGKSTVISLIERFYEPISGQILLDRNDIRELDLKWLRQQIGLVNQEPALFATSIKENILYGKDDATLEELKRAVKLSDAQPFINNLPDRLETQVGERGIQLSGGQKQRIAISRAIVKNPSILLLDEATSALDAESEKSVQEALDRVMVGRTTVVVAHRLSTIRNADMIAVVQGGKIVETGNHEELMANPTSVYASLVQLQEAASLHRLPSIGPSMGCQPSITYSRELSRTTTSLGGSFRSDKESIGRVCAEETENAGKKRHVSAARLYSMVGPDWFYGVAGTLCAFIAGAQMPLFALGISHALVSYYMDWETTCHEVKKIAFLFCGAAVITVTVHAIEHLSFGIMGERLTLRVREMMFSAILKNEIGWFDDTNNTSSMLSSQLETDATLLRTIVVDRSTILLQNIGLVIASFIIAFILNWRITLVVIATYPLVISGHISEKLFMKGYGGNLSKAYLKANMLAGEAVSNIRTVAAFCSEEKVLDLYANELVDPSKRSLQRGQIAGIFYGISQFFIFSSYGLALWYGSVLMEKELASFKSIMKAFFVLIVTALAMGETLALAPDLLKGNQMVASVFEVMDRKSGISCDVGEELKTVDGTIELKRINFSYPSRPDVIIFKDFNLRVPAGKSVALVGQSGSGKSSVISLILRFYDPTSGRVLIDGKDITRLNLKSLRRHIGLVQQEPALFATSIYENILYGKEGASDSEVIEAAKLANAHNFISGLPEGYSTKVGERGVQLSGGQRQRVAIARAVLKNPEILLLDEATSALDVESERIVQQALDRLMQNRTTIMVAHRLSTIRNADQISVLQDGKIIDQGTHSSLIENKNGAYYKLVNLQQQHQL

SEQ ID NO: 693 - protein, 71 aa, Brassica oleracea
MSQYNNQSAGANSPPPMSTGPAPPPPMGYPTNDPSHGSAAPVKVETSSKGDGFFKGCLAAMCCCCALDICF

SEQ ID NO: 694 - protein, 71 aa, Brassica rapa
MSQYNNQSAGANSPPPMSTGPAPPPPMGYPTNDPSHGSAAPVKVETNSKGDGFFKGCLAAMCCCCALDICF

SEQ ID NO: 695 - protein, 72 aa, Brassica rapa
MSQYNHNQSSGVNPPPPMSTGPSPPPPIGYPTVDPSHGSAAPVKVETSSKGDGFFKGCLAAMCCCCALDICF

SEQ ID NO: 696 - protein, 71 aa, Brassica napus; identical to SEQ ID NO: 693

SEQ ID NO: 697 - protein, 72 aa, Brassica napus; identical to SEQ ID NO: 695

SEQ ID NO: 698 - protein, 71 aa, Brassica napus; identical to SEQ ID NO: 694

SEQ ID NO: 699 - protein, 73 aa, Raphanus sativus
MSQYNHNQFAGATNPSPPMSTGPAPPAPIGYPTNDPSHGSAAPVKVETNSKGDGFFKGCLAAMCCCCALDICF

SEQ ID NO: 700 - protein, 72 aa, Thellungiella halophila
MSQYNNHNQSAGANPPPPISTGGPQPPIGYPTSDPSHGSVAPVKAETKSKGDGFFKGCLAAMCCCCALDICF

SEQ ID NO: 701 - protein, 326 aa, Hordeum vulgare
MASGSGEGKAGRAGAGYQQYASYGTGTGYDERQWWPWLVPTVLGACVSVFAVEMYLNDCPRHGSTLGGDAPCVAGFLRQFSFQPLRENPLLGPSSATLEKMGALDWAKVVHQHQWWRLFSCVWLHAGLIHLIVNMMSLLFIGIRLEQQFGFVRIGIIYLLSGFGGSVLSALFLRNHYISVGASGALFGLLGSMLSELIMNWTIYSNKAAAITTLLFIIAINLAIGILPHADNFAHIGGFVSGFLFGFVLLARPQFGWMERHELPQTDQPPKYKMYQYALWGAALLFLLVGYVVGLAMLFKGKNGNDGCHWCRYLNCVPTSRWKCST

SEQ ID NO: 702 - protein, 321 aa, Hordeum vulgare
MEGGGEGKGRAATAAGGGGFGGYESAGDRKWWPWLVPTVIVACVAVFVVEMWVNDCPRHGSALGGGCVAGFLRRFSFQPLRENPLLGPSSTTLGKMGALDWNKVVHQHQGWRLISCIWLHAGLIHLVVNMLSLLFIGIRLEQQFGFVRIGAIYLLSGFGGSVMSALFLRNNYISVGASGALFGLLGSMLSELLMNWTIYSNKVAAIITLLFIIAINVAIGILPHADNFAHIGGFLTGFLLGFVLLARPQFGWLERSELPHTNQPPKYKPYQYVLWVVAFVLLLVGFTISLVMLFKGKNGNDGCHWCHYLNCVPTSRWKCDT

SEQ ID NO: 703 - protein, 321 aa, Brachypodium distachyon
MANGGGEGKAGAGYQYGPYGVVREERQWWPWLVPAVLGACVTVFAVEMYNNDCPRHGSTLGGGDAPCVAGFLRRFAFQPLRENPLLGPSSATLEKLGALDWAKVVHQHQGWRLISCIWLHAGLIHLIVNMLSLLFIGIRLEQQFGFVRIGIIYLLSGFGGSVLSALFLRNHYISVGASGALFGLLGSMLSELIMNWTIYSNKAAAIITLLFIIVINLAIGILPHADNFAHIGGFVSGFLIGFVLLARPQFGWMERNELPQTDQPPKYKTYQYVLWGVALLLLLVGYVVTLALLFKGKNGNDGCHWCRYLNCVPTSRWKCGT

SEQ ID NO: 704 - protein, 330 aa, Brachypodium distachyon
MEGNGEGKGRAPGPAATAAGGGGGGYGYGGYDGAGGDRKWWPWLVPTVIVACIAVFVVEMWVNDCPRHGSALGGGCVVGFLRRFSFQPLRENPLLGPSSATLGKMGALDWNKVVHEHQGWRLISCIWLHAGLIHLVVNMLSLLFIGIRLEQQFGFVRIGAIYLLSGFGGSVLSALFLRSNYISVGASGALFGLLGSMLSELIMNWTIYSNKVAAIITLLFIIAINMAIGILPHADNFAHIGGFVTGFLLGFVLLARPQFGWMERNELPHTNQPPKYKAYQYVLWVVALLLLLVGFVTSLVMLFKGKNGNDGCHWCHYLNCVPTSKWKCNT

SEQ ID NO: 705 - protein, 325 aa, Festuca arundinacea
  misc_feature (63)..(63): Xaa can be any naturally occurring amino acid
  misc_feature (67)..(67): Xaa can be any naturally occurring amino acid
MDANGAEKGRAAPAPAGGGGAYGGYEGAGDRKWWPWLVPTVIVACIAVFVVEMWVNDCPKHGXALGXGQPCVAGFLRRFSFQPLRENPLLGPSSATLAKMGALDWNKVVHQNQGWRLISCIWLHAGLIHLLVNMLSLLFIGIRLEQQFGFVRIGAIYLLSGFGGSVLSALFLRNNYISVGASGALFGLLGSMLSELLMNWTIYSNKIAAIITLLFIIVINVAIGILPHADNFAHIGGFIAGFFLGFVLLARPQFGWMERSELPHTNQPPKYKAYQYVLWVVALVLLLVGFILSLVMLFKGKNGNDGCHWCHYLNCVPTSKWKCDT

SEQ ID NO: 706 - protein, 324 aa, Leymus cinereus x Leymus triticoides
  misc_feature (18)..(18): Xaa can be any naturally occurring amino acid
  misc_feature (68)..(68): Xaa can be any naturally occurring amino acid
  misc_feature (249)..(249): Xaa can be any naturally occurring amino acid
  misc_feature (289)..(289): Xaa can be any naturally occurring amino acid
  misc_feature (316)..(316): Xaa can be any naturally occurring amino acid
  misc_feature (319)..(319): Xaa can be any naturally occurring amino acid
MASGSGEGKAGRAGAGYXQYASYGTGYDERQWWPWLVPTVLGACVSVFAVEMYVNDCPRHGSPLGGDXACVAGFLRQFSFQPLRENPLLGPSSATLEKMGALDWAKVVHQHQWWRLFSCIWLHAGLIHLIVNMMSLLFIGIRLEQQFGFVRIGIIYLLSGFGGSVLSALFLRNHYISVGASGALFGLLGSMLSELIMNWTIYSNKAAAIITLLFIIAINLAIGILPHADNFAHIGGFVSGFLFGFVLLXRPQFGWMERHELPQTDQPPKYKTYQYVLWGAALLLLLVGXVVGLAMLFKGKNGNDGCHWCRYLNCVXTSXWKCST

SEQ ID NO: 707 - protein, 327 aa, Zea mays
MASDGDGKGRVATAPGAGGYGYGYGYAGFEGEEDRKWWPWLVPTVIVACIAVFVVEMYENNCPKNRSQLGGDCVAGFLRRFSFQPLRENPLLGPSSSTLEKMGALDWNKIVHQNQGWRLISCIWLHAGLIHLVVNMLSLLFIGIRLEQQFGFVRIGAIYLLSGFGGSVLSALFLRNNYISVGASGALFGLLGSMLSELLMNWTIYSNKAAAIITLLFIIALNLAIGILPHADNFAHIGGFATGFLLGFVLLARPQFGWMEHHELPQTNQPPKYKAYQYILWVVALVLLLVGFVISLVMLFKGKNGNDGCHWCHYLNCVPTSKWKCNT

SEQ ID NO: 708 - protein, 324 aa, Zea mays
MASDGDGKGRVATAPGAGYGYAAYGGYQGAEERKWWPWLVPTVIVACIAVFVVEMYENNCPKHGSQLGDCVAGFLRRFSFQPLRENPLLGPSSSTLEKMGALDWNKIVHQNQGWRLISCIWLHAGLIHLVVNMLSLLFIGIRLEQQFGFVRIGAIYLLSGFGGSVLSALFLRNSYISVGASGALFGLLGSMLSELLMNWTIYSNKAAAIITLLFIIALNLAIGILPHVDNFAHIGGFATGFLLGFVLLARPQFSWMESHELPHTNQPPKYKAYQYILWVVALVLLLVGFVISLVMLFKGKNGNDGCHWCHYLNCVPTSKWKCNT

SEQ ID NO: 709 - protein, 322 aa, Zea mays
MATGGQGKAAGYYQYPTSYAGAADEERRWWPWLVPTVLVACIAVFAAEMFVNDCPRHGSTLGGGAGCVAAGLLRRFSFQPLRENPLFGPSSATLEKMGALNWAKVVHEHQGWRLISCIWLHAGLVHLVVNMLSLLFIGIRLEQQFGFVRIGVIYLISGFGGSVLSALFLHSNYVSVGASGALFGLLGSMLSELIINWTIYSNKAAAIITLLFIIVINLAIGILPHADNFAHIGGFASGFLIGFVLLARPQFGWMERSELPQTSQPPKYKSYQYVLWVAALLLLVVGFAIILVMLFTGKNGNDSCHWCHYLNCVPTSRWKCDT

SEQ ID NO: 710 - protein, 322 aa, Pseudoroegneria spicata
MEGGGEGKGRAAAATAAGGGFGGYESAGDRKWWPWLVPTVIVACVAVFVIEMWVNDCPRHGSALGGGCVAGFLRRFSFQPLRENPLLGPSSTTLGKMGALDWNKVVHQHQGWRLISCIWLHAGLIHLVVNMLSLLFIGIRLEQQFGFVRIGAIYLLSGFGGSVMSALFLRNNYISVGASGALFGLLGSMLSELLMNWTIYSNKVAAIITLLFIIAINVAIGILPHADNFAHIGGFLTGFLLGFVLLARPQFGWLERSELPHTNQPPKYKPYQYVLWVVALVLLLVGFTISLVMLFKGKNGNDGCHWCHYLNCVPTSRWKCDT

SEQ ID NO: 711 - protein, 324 aa, Pseudoroegneria spicata
MASGSGEGKAGRAGAGYQQYASYGTGYDERQWWPWLVPTVLGACVSVFAVEMYLNDCPRHGSPLGSDAPCVAGFLRQFSFQPLRENPLLGPSSATLEKMGALDWAKVVHQHQWWRLFSCVWLHAGLIHLIVNMMSLLFIGIRLEQQFGFVRIGIIYLLSGFGGSVLSALFLRNHYISVGASGALFGLLGSMLSELIMNWTIYSNKAAAITTLLFIIAINLAIGILPHADNFAHIGGFVSGFLFGFVLLARPQFGWMERHELPQTDQPPKYKTYQYVLWGAALLLLLVGYVVGLAMLFKGKNGNDGCHWCRYLNCVPSSRWKCST

SEQ ID NO: 712 - protein, 323 aa, Oryza sativa
MASSSGEGKGAGGAGYQYAPYGGSYYDEERRWWPWLVPTVLVACIVVFLVEMFVNDCPRHGSPLRGESCVAGFLHQFAFQPLRENPLLGPSSATLEKMGALDWAKVVHQHQAWRLISCIWLHAGLIHLIVNMLSLLFIGLRLEQQFGFVRIGIIYLLSGFGGSVLSVLFLRNNYISVGASGALFGLLGSMLSELIMNWTIYSNKAAAIITLLFIIAINLAIGILPHADNFAHIGGFVTGFLLGFVLLARPQFGWMERHELPQTNQPRKYRAYQYVLWAVALFLLLVGFVIALVMLFKGKNGNDGCHWCHYLNCIPTSRWKCST

SEQ ID NO: 713 - protein, 332 aa, Sorghum bicolor
MATGGGQQGKAAGYYQYPASYSYAGAAAAAAEEERRWWPWLVPTVLVACIAVFAAEMFVNDCPRHGSALGGGAGSGCVAAGLLRRFSFQPLRENPLFGPSSATLEKMGALNWAKVVHEHQGWRLISCIWLHAGLVHLVVNMLSLLFIGIRLEQQFGFVRIGVIYLISGFGGSVLSALFLHSNYISVGASGALFGLLGSMLSELIMNWTIYSNKAAAIITLLFIIAINLAIGILPHADNFAHIGGFASGFLLGFVLLARPQFGWMERSELPQTNQPPKYKLYQYVLWVAALLLLVVGFVIILVMLFKGKNGNDSCHWCHYLNCVPTSRWKCDT

SEQ ID NO: 714 - protein, 325 aa, Sorghum bicolor
MASDGDGKGRVATAPGGGYGYGYGYGGYEGFEDRKWWPWLVPTVIVACIAVFVVEMYENNCPKNRSQLGGCVAGFLRRFSFQPLRENPLLGPSSSTLEKMGALDWNKIVHQNQGWRLISCIWLHAGLIHLVVNMLSLLFIGIRLEQQFGFVRIGAIYLLSGFGGSVLSALFLRNNYISVGASGALFGLLGSMLSELLMNWTIYSNKAAAIITLLFIVALNLAIGILPHADNFAHIGGFATGFLLGFVLLARPQFSWMERHELPQTNQPPKYKAYQYILWVVALVLLLVGFVVSLVMLFKGKNGNDGCHWCHYLNCVPTSKWKCNT

SEQ ID NO: 715 - protein, 325 aa, Saccharum officinarum
MASDGDGKGRVATAPGGGYGYGYGYGGYEGPEDRKWWPWLVPTVIVACIAVFVVEMYENNCPKHGSQLGGCVAGFLRRFSFQPLRENPLLGPSSSTLEKMGALDWNKIVHQDQGWRLISCIWLHAGLIHLVVNMLSLLFIGIRLEQQFGFVRIGAIYLLSGFGGSVLSALFLRNNYISVGASGALFGLLGSMLSELLMNWTIYSNKAAAIITLLFIIALNLAIGILPHVDNFAHIGGFATGFLLGFVLLARPQFSWMERHELPQTNQPPKYKAYQYILWVVALVLLLVGFVISLVMLFKGKNGNDGCHWCHYLNCVPTSKWKCNT

SEQ ID NO: 716 - protein, 323 aa, Panicum virgatum
MASNGDGKGRVAAAAGGGYGYGYGGYEGPEERKWWPWLVPTVIVACIAVFVVEMYENNCPKHGSQLGDCVAGFLRRFSFQPFRENPLLGPSSSTLEKMGALDWNKIVHQHQGWRLISCIWLHAGLIHLVVNLLSLLFIGIRLEQQFGFVRIGAIYLLSGFGGSVLSALFLRNNYISVGASGALFGLLGSMLSELLMNWTIYSNKAAAIITLLFIIALNLAIGILPHADNFAHIGGFATGFLLGFVLLARPQFGWMERHELPETSQPPKYKAYQYVLWVLALVLLLVGFVISLVMLFKGKNGNDGCHWCHYLNCVPTSKWKCNT

SEQ ID NO: 717 - protein, 325 aa, Panicum virgatum
MASNGDGKGRVAAAAAPGGGYGYGYGGYEGPEERKWWPWLVPTVIVACIAVFVVEMYENNCPRHGSQFGGCVAGFLRRFSFQPLRENPLLGPSSSTLEKMGALDWNKIVHQHQGWRLISCIWLHAGLIHLVVNMLSLLFIGIRLEQQFGFVRIGAIYLLSGFGGSVLSALFLRNNYISVGASGALFGLLGSMLSELLMNWTIYSNKAAAIITLLFIIALNLAIGILPHADNFAHIGGFATGFLLGFVLLARPQFGWMERHELPQTSQPPKYKAYQYVLWVVAFVLLLVGFVISLVMLFKGKNGNDGCHWCHYLNCVPTSKWKCDT

SEQ ID NO: 718 - protein, 320 aa, Triticum aestivum
MEGGGEGKGRAAPAAGGGFGGYESAGDRKWWPWLVPTVIVACVAVFVVEMWVNDCPRHGSALGGGCVAGFLRRFSFQPLRENPLLGPSSTTLGKMGALDWNKVVHQHQGWRLISCIWLHAGLIHLVVNMLSLLFIGIRLEQQFGFVRIGAIYLLSGFGGSVMSALFLRNNYISVGASGALFGLLGSMLSELLMNWTIYSNKVAAIITLLFIIAINVAIGILPHADNFAHIGGFLTGFLLGFVLLARPQFGWLERSELPHTNQPPKYKPYQYVLWVVALVLLLVGFTLSLVMLFKGKNGNDGCHWCHYLNCVPTSRWKCDT

SEQ ID NO: 719 - protein, 323 aa, Triticum aestivum
MASGSGSGEGKAGRAGAGYQQYGTGYDERQWWPWLVPTVLGACVSVFAVEMYLNDCPRHGSPLGGDARCVAGFLRQFSFQPLRENPLLGPSSATLEKMGALDWAKVVHQHQWWRLFSCIWLHAGLIHLIVNMMSLLFIGIRLEQQFGFVRIGIIYLLSGFGGSVLSALFLRNHYISVGASGALFGLLGCMLSELIMNWTIYSNKAAAITTLLFIIAINLAIGILPHADNFAHIGGFVSGFLFGFVLLARPQFGWMERHELPQTDQPPKYKTYQYVLWGAALLLLLVGYVVGMAMLFKGKNGNDGCHWCRYLNCVPSSRWKCST

SEQ ID NO: 720 - protein, 328 aa, Triticum aestivum
MASGSGSGEGKAGRAGAGYQQYASYGTGTGYDERQWWPWLVPTVLGACVSVFAVEMYLNDCPRHGMYLGGDASCVAGFLRQFSFQPLRENPLLGPSSATLEKMGALDWAKVVHQHQWWRLFSCIWLHAGLIHLIVNMMSLLFIGIRLEQQFGFVRIGIIYLLSGFGGSVLSALFLRNHYISVGASGALFGLLGSMLSELIMNWTIYSNKAAAITTLLFIIAINLAIGILPHADNFAHIGGFVSGFLFGFVLLARPQFGWMERHELPQTDQPPKYKTYQYALWGAALLLLLVGYVVGLAMLFKGKNGNDGCHWCRYLNCVPSSRWKCST

SEQ ID NO: 721 - protein, 323 aa, Triticum aestivum
MEGGGEGKGRAAPAAAAAGGGFGGYESAGDRKWWPWLVPTVIVACVAVFVVEMWVNDCPRHGSALGGGCVAGFLRRFSFQPLRENPLLGPSSTTLGKMGALDWNKVVHQHQGWRLISCIWLHAGLIHLVVNMLSLLFIGIRLEQQFGFVRIGAIYLLSGFGGSVMSALFLRNNYISVGASGALFGLLGSMLSELLMNWTIYSNKVAAIITLLFIIAINVAIGILPHADNFAHIGGFLTGFLLGFVLLARPQFGWLERSELPHTNQPPKYKPYQYVLWVVALVLLLVGFTLSLVMLFKGKNGNDGCHWCHYLNCVPTSRWKCDT

SEQ ID NO: 722 - protein, 322 aa, Triticum aestivum
MEGGGEGKGRAAPATAAGGGFGGYESAGDRKWWPWLVPTVIVACVAVFVVEMWVNDCPRHGSALGGGCVAGFLRRFSFQPLRENPLLGPSSTTLGKMGALDWNKVVHQHQGWRLISCIWLHAGLIHLVVNMLSLLFIGIRLEQQFGFVRIGAIYLLSGFGGSVMSALFLRNNYISVGASGALFGLLGSMLSELLMNWTIYSNKVAAIITLLFIIAINVAIGILPHADNFAHIGGFLTGFLLGFVLLARPQFGWLERSELPHTNQPPKYKPYQYVLWVVALVLLLVGFTLSLVMLFKGKNGNDGCHWCHYLNCVPTSRWKCDT

SEQ ID NO: 723 - protein, 439 aa, Oryza sativa
MAGGEDISFLFGDDEAAAVAAPVELQGKRGWEEVDQGEGSGAVAAKRQRSPTSSRENSSGSNEGGQEEVSEAAAAMAAAVGRGGGRRLWVKERDSEWWDMVSSPDYPDSEFRKAFRMSKATFEVVCDELAAAVAKEDTMLRAAIPVRKRVAVCVWRLATGEPLRLVSKRFGLGISTCHKLVLEVCAALKAMVMPKVVRWPEAGDAAAIAAHFEAISGISGVVGAIYTTHIPIIAPKSNVASYYNRRHTERNQKTSYSMTVQCVVDSTGAFTDVCIGWPGSNSDEEVLEKSALYLHRGVPGLIQGQWVVGGGSFPLMDWMLVPYTHQNLTWAQHMLNEKVAAVRGVARDAFERLKRRWGCLQKRTEVKLLDLPTVLGACCVLHNICERSGDAVVDADDCAFDLFDDDMVAENAVRSSAAAQARDAIAHNLLHSGGGASFF

SEQ ID NO: 724 - protein, 155 aa, Persea americana
  misc_feature (34)..(34): Xaa can be any naturally occurring amino acid
  misc_feature (140)..(140): Xaa can be any naturally occurring amino acid
  misc_feature (143)..(144): Xaa can be any naturally occurring amino acid
  misc_feature (146)..(148): Xaa can be any naturally occurring amino acid
  misc_feature (150)..(154): Xaa can be any naturally occurring amino acid
MENARTVKDVSPHQFVKAYSAHLKRSGKMELPHXTDIVKTGNFKELAPYDPDWYYIRAASMARKIYLRQGIGVGAFQKIYGGRKRNGSRPPHFCKSSGSVARHILQQLQKMNIIDIDPKGGRRITSSGQRDLDQVAGRIXVAXXPXXXFXXXXXV

SEQ ID NO: 725 - protein, 141 aa, Musa acuminata
MENAVAKTVKDVSPHEFVKAYSAHLKRSGKMELPEWTDIVKTGRFKELAPYDPDWYYIRAASMARKIYLRQGIGVGGFQKIYGGRKRNGSRPPHFCKSSGAIARHILQQLERMNIIEIEPKGGRKITSQGQRDLDQVAGRV

SEQ ID NO: 726 - protein, 148 aa, Musa acuminata
MATVENAVAKTVKDVSPHDFVKAYSAHLKRSGKMELPEWTDIVKTGRFKELAPYDPDWYYIRAASMARKIYLRQGIGVGGFQKIYGGRKRNGSRPPHFCKSSGAIARHILQQLETMNIIEINPKGGRKITSQGQRDLDQVAGRVSVLP

SEQ ID NO: 727 - protein, 139 aa, Musa acuminata
NDVAKTVKDVSPHEFVKAYSAHLKRSGKMELPEWTDIVKTGRFKELAPYDPDWYYIRAASMARKIYLRQGIGVGGFQKIYGGRKRNGSRPPHFCKSSGAIARHILQQLQRMNIIEIEPKGGRRITSQGQRDLDQVAGRV

SEQ ID NO: 728 - protein, 150 aa, Hordeum vulgare
MATVPAPADETAGSTARTVKDVNPHEFVKVYSAHLKRSCKMELTEWVDIVKTARFKELPPTDADWYYIRAASMARKIYLRQGIGIGGFQKIYGGRQRNCSRPPHLCKSSGAVSRNILHELQKMGIIDVDPKGGRLITSQGRRDLDQVAGT

SEQ ID NO: 729 - protein, 155 aa, Hordeum vulgare
MATVPAPAAETAASTARTVKDVNPHEFVKAYSAHLKRSGKMELPEWVDIVKTARFKELPPTDADWYYIRAASMARKIYLRQGIGIGGFQKIYGGRQRNGSRPPHFCKSSGAVSRNILQELQKMGIIDVDPKGGRLITSQGRRDLDQVAGTVPAEF

SEQ ID NO: 730 - protein, 115 aa, Hordeum vulgare
MELPEWVDIVKTARFKELPPTDADWYYIKAASMARKIYLMHGIGIGGFQKIYGGRQRNGSRPPHFWKSSGADCRYILQELQKMGIIDVDANGGRLITSRGRRDLDHVAGTVPAEF

SEQ ID NO: 731 - protein, 153 aa, Brachypodium distachyon
MATPTETAAAASSALTVKDVAPHDFNKKYAAHLKRSGKMELPEWVDIVKTARFKELPPNDPDWYYIRAASIARKIYLRQGIGIGGFQKIYGGRQRNGSRPPHFCKSSGAISRNILQELQKMGIIDVDPKGGRIITSQGRRDLDQVAGTVAPEI

SEQ ID NO: 732 - protein, 145 aa, Brachypodium distachyon
AAASSALTVKDVAPHDFNKKYAAHLKRSGKMELPEWVDIVKTARFKELPPNDPDWYYIRAASIARKIYLRQGIGIGGFQKIYGGRQRNGSRPPHFCKSSGAISRNILQELQKMGIIDVDPKGGRIITSQGRRDLDQVAGTIAPEV

SEQ ID NO: 733 - protein, 145 aa, Brachypodium distachyon
ATASSALTVKDVAPHDFNKKYTAHLKRSGKMELPEWVDIVKTARFKELPPNDPDCYYIRAASIGRKIYLRQGIGIGGFQKIYGGRQRNGSRPPHFCKSSGAISRNILHELQKMGIIDVDPKGGRIITSQGRRDLDQVAGTVAPEV

SEQ ID NO: 734 - protein, 145 aa, Cenchrus ciliaris
  misc_feature (54)..(54): Xaa can be any naturally occurring amino acid
  misc_feature (56)..(56): Xaa can be any naturally occurring amino acid
  misc_feature (68)..(70): Xaa can be any naturally occurring amino acid
  misc_feature (108)..(109): Xaa can be any naturally occurring amino acid
  misc_feature (111)..(112): Xaa can be any naturally occurring amino acid
  misc_feature (124)..(125): Xaa can be any naturally occurring amino acid
MAASTARTVKDVNPPYFEKAYSAHLKRSGKMELPEWVDIVKTARFKELPPYDPXWXYTRAASIARKIXXXQGIGVGGFQKIYGGRQRNGSRPPHFCKSSGAISRNILXXLXXMGIIDVDPKGGXXITSQGRRDLDQVAGRVAVEA

SEQ ID NO: 735 - protein, 146 aa, Cichorium intybus
METATARTVKDVSPHEFVKAYAAHLKRSGKMELPHWTDIVKTATFKELAPYDPDWYYIRAASMARKIYLRGGIGVGAFQRIYGGRKRNGSAPPHFCKSSGGIARHILQQLQTMNIVDFDAKGGRKITSNGRRDLDQVAGRVVVVTP

SEQ ID NO: 736 - protein, 143 aa, Cichorium intybus
MATARTVKDVSPHEFVQGYAAHLKRSGKMELPEWTDIVKTATFKELAPYDPDWYYIRAASIARKIYLRGGIGVGAFQRIYGGRKRNGSAPPHFCKSSGGIVRHILQQLETMKIIDMDPKGGRRITSNGRRDLDQVAGRIVVAP

SEQ ID NO: 737 - protein, 143 aa, Citrus sinensis
MATARTVKDVSPHEFVKAYSAHLKRSGKMELPPWTDIVKTAQFKELAPYDPDWYYVRAASMARKIYLRQGLGVGSFRRIYGGSKRNGSRPPHFCKSSGAIARHILQQLQNMNIIDIEPKGGRRITSSGQRDLDQVAGRIVVAP

SEQ ID NO: 738 - protein, 143 aa, Trifolium pratense
MATARTVKDVSPHEFVKAYSAHLKRSGKMELPEWTDIVKTAKFKELAPYDPDWYYIRAASMARKIYMRGGLGVGAFQRIYGGSQRNGSRPPHFCKSSGAIARHILQQLQNLNIIEMDTKGGRKITSNGRRDLDQVAGRIVVAP

SEQ ID NO: 739 - protein, 143 aa, Vigna unguiculata
MATARTVKDVSPHEFVKAYSSHLKRSGKMELPEWTDIVKTARFKELAPYDPDWYYVRAASMARKIYLRGGLGVGAFQRIYGGSKRNGSRPPHFCKSSGAIARHILQQLQTMNIIELDTKGGRRITSSGRRDLDQVAGRIVVAP

SEQ ID NO: 740 - protein, 143 aa, Taraxacum officinale
MATARTVKDVSPHEFVKGYAAHLKRSGKMELPEWTDIVKTATFKELAPYDPDWYYIRAASIARKIYLRGGIGVGAFQRIYGGRKRNGSAPPHFCKSSGGIIRHILQQLETMKIIDMDPKGGRRITSSGRRDLDQVAGRIVVAV

SEQ ID NO: 741 - protein, 153 aa, Festuca arundinacea
MATEAPAETAASTARTVKDVNPHAFVKAYSAHLKRSGKMELPEWVDIVKTARFKELPPYDADWYYIRAASMARKIYLRQGIGIGGFQKIYGGRQRNGSRPPHFCKSSGAVSRNILQELQKMGIVDVDPKGGRLITSQGRRDLDQVAGTVPAEF

SEQ ID NO: 742 - protein, 141 aa, Zingiber officinale
MEISASKTVKDVSPHEFVKAYSSHLKRSGKMELPEWTDIVKTGRFKELAPYDPDWYYIRAASMARKIYLSQGIGVGGFQKIYGGRKRNGSRPPHFCKSSGAIARHILQQLETMNIIEINPKGGRKISSQGQRDLDQVAGRV

SEQ ID NO: 743 - protein, 144 aa, Ipomoea nil
MATARTVKDVSPHEFVKAYSAHLKRSGKMELPEWTDIVKTGRLKELAPYDPDWYYIRAASMARKIYLRGGLGVGAFQRIYGSNKRNGSCPRHFCKSSGAIARHILQQLQTMSIIEVDPRGGRRITSSGQRDLDQVAGRIVVVAP

SEQ ID NO: 744 - protein, 144 aa, Ipomoea nil; identical to SEQ ID NO: 743

SEQ ID NO: 745 - protein, 143 aa, Lactuca sativa
  misc_feature (138)..(138): Xaa can be any naturally occurring amino acid
MATARTVKDVSPHEFVKAYSAHLKRSGKMELPEWTDIVKTATFKELAPYDPDWYYIRAASIARKIYLRGGLGVGAFQRIYGGRKRNGSAPPHFCKSSGGIARHILQQLETMKIIDMDPKGGRRITSNGRRDLDQVAGXIVLAP

SEQ ID NO: 746 - protein, 144 aa, Lactuca sativa
MATARTVKDVSPHEFVKGYAAHLKRSGKMELPEWTDIVKTATFKELAPYDPDWYYIRAASIARKIYLRGGLGVGALQRIYGGRKRNGSAPPHFCKSSGGIARHILQQLETMKIIDMDPKGGRRITSNGRRDLDQVAGRIVVVAP

SEQ ID NO: 747 - protein, 144 aa, Lactuca sativa; identical to SEQ ID NO: 746

SEQ ID NO: 748 - protein, 144 aa, Lactuca sativa; identical to SEQ ID NO: 746

SEQ ID NO: 749 - protein, 143 aa, Glycyrrhiza uralensis
MATSRTVKDVSPHEFVKAYASHLKRSGKMELPEWTDIVKTARFKELAPYDPDWYYIRAASMARKIYLRGGLGVGAFQRIYGGSQRNGSRPPHFCKSSGAIARHILQQLQNMSIIELDTKGGRRITSSGRRDLDQVAGRIVVAP

SEQ ID NO: 750 - protein, 143 aa, Glycyrrhiza uralensis
MATARTVKDVSPHEFVKAYASHLKRSGKMELPEWTDIVKTARFKELAPYDPDWYFVRSASMARKIYLRGGLGVGAFQRIYGGSKRNGSRPPHFCKSSGAIARHILQQLQDMNIIELDTKGGRRITSSGRRDLDQVAGRIVVAP

SEQ ID NO: 751 - protein, 143 aa, Liriodendron tulipifera
MEAARTVKDVSPHDFVKAYSAHLKRSGKMELPHWTDIVKTARFKELAPYDPDWYYIRAASMARKIYLRQGIGVGGFQKIYGGRKRNGSRPPHFCKSSGSIARHILQQLQQMSIIDIDPKGGRRITSSGQRDLDQVAGRIVVTP

SEQ ID NO: 752 - protein, 143 aa, Lotus japonicus
MASAKTVKDVSPHEFVKAYSAHLKRSGKMELPEWTDIVKTARFKELAPYDPDWYYVRAASMARKIYLRGGLGVGAFQRIYGGSQRNGSRPPHFCKSSGAIARNILQQLQEMNIIEMDTKGGRRITSSGRRDLDQVAGRIVVAP

SEQ ID NO: 753 - protein, 144 aa, Lotus japonicus
MSTARTVKDVSPHEFVKAYAAHLKRSGKMELPEWTDIVKTARFKELAPYDPDWYYIRAASMARKIYLRGGLGVGAFQRIYGGSQRNGSRPPHFCKSSGSIARHILQQLQTMHIIELDNKGGRKITSSGRRDLDQVAGRIVVVAP

SEQ ID NO: 754 - protein, 163 aa, Eragrostis curvula
  misc_feature (29)..(29): Xaa can be any naturally occurring amino acid
  misc_feature (36)..(36): Xaa can be any naturally occurring amino acid
  misc_feature (49)..(49): Xaa can be any naturally occurring amino acid
  misc_feature (75)..(75): Xaa can be any naturally occurring amino acid
FPPWKAGGGGEEGPTTAEWRPPPLKRVKXVNPHDIXTAYSAHLKRSGKXELPEWVDIVKTARFKELPPYDPDWYXIRAASIARKIYLRQGIGVGGFQKIYGGRQRNGSRPPHFCKSSGAISRNILQQLQKMGIIDVDPKGGRLITSQGRRDLDQVAGRVAIVE

SEQ ID NO: 755 - protein, 145 aa, Zea mays
MAESTARTVKDVNPHEFVKAYSAHLKRSGKMELPEWVDIVKTARFKELPPYDPDWYYIRAASIARKIYLRQGIGVGGFQKIYGGRQRNGSRPPHFCKSSGAVARNILQQLQIMGIIDVDPKGGRLITNQGRRDLDQVAGRVAVEA

SEQ ID NO: 756 - protein, 145 aa, Zea mays; identical to SEQ ID NO: 755

SEQ ID NO: 757 - protein, 143 aa, Cucumis melo
MATARTVKDVSPHEFVKAYAAHLKRSGKVELPPWADIVKTARFKELAPYDADWYYVRAASMARKIYLRGGLGVGAFKRIYGGSKRNGSRPPHFCESSGAIARHILQQLQEMNIVDVDPKGGRRITSSGRRDLDQVAGRIVVAP

SEQ ID NO: 758 - protein, 161 aa, Pennisetum glaucum
MAASTARTVKDVNPHEFVKAYSAHLKRSGKMELPEWVDIVKTARFKELPPYDADWYYTRAASIARKIYLRQGIGVGGFQKIYGGRQRNGSRPPHFCKSSGAISRNILQQLQKMGIIDVDPKGGRLITSQGRRDLDQVAGRVAVNFEQVSSSVRLLCSGMGG

SEQ ID NO: 759 - protein, 143 aa, Nuphar advena
MAAARTVKDVSPHDFVSSYSSHLKRSGKMELPHWTDIVKTATFKELAPYDPDWYYVRAASIARKIYLRQGIGVGGFQKIYGGRKRNGSRPPHFCKSSGSIARHILQQLEKMNIIEMNPKGGRRITSSGQRDLDQVAGRIAVTA

SEQ ID NO: 760 - protein, 172 aa, Avena sativa
GAPPLLPSWRQRPRRREDKMAAAPPAETAASTARTVKDVNPHEFVKAYSAHLKRSGKMELPEWVDIVKTARFKELPPYDADWYYIRAASMARKIYLRQGIGIGGFQKIYGGRQRNGSRPPHFCKSSGAVSRNILQELQKMGIVDVDPKGGRLITSQGRRDLDQVAGTVPAEF

SEQ ID NO: 761 - protein, 163 aa, Elaeis guineensis
PSLSLPLDRRREQLPAAVTMEAAARTVKDVSAHEFVKAYAAHLKRSGKMELPHWTDIVKTGRFKELAPYDPDWYYIRAASMARKIYLRQGIGVGGFQKIYGGRKRNGSRPPHFCKSSGAIARHILQQLQEMDIIDFDPKGGRMITSQGRRDLDQVAGRVVVAP

SEQ ID NO: 762 - protein, 143 aa, Elaeis guineensis
METARTVKDVSAHEFVKAYAAHLKRSGKMELPHWTDIVKTGRFKELAPYDPDWYYIRAASMARKIYLRHGIGVGGFQKIYGGRKRNGSRPPHFCKSSGAIARHILQQLQEMDIIDFDAKGGRMITSQGRRDLDQVAGRVVVAP

SEQ ID NO: 763 - protein, 144 aa, Elaeis guineensis
MEAASRTVKDVSPHDFVKAYAAHLKRSGKMELPHWTDIVKTGRFKELAPYDPDWYYIRAASMARKIYLRQGIGVGGFQKIYGGRKRNGSRPPHFCKSSGAIARHILQQLQNMNIIDIDPRGGRKITSQGQRDLDQVAGRIVLVP

SEQ ID NO: 764 - protein, 148 aa, Allium cepa
MAEEAAVGRTVKDVCPHEFVKAYSAHLKRSGKMELPQWTDIVKTGKFKELAPYDPDWYYIRAASMARKIYLRQGIGVGGFQKIYGGSQSNGSRPSHFCKSSGAVARSILHQLEAMDIVEKDAKGGRKITSQGRRDLDQVAGRVQAVPA

SEQ ID NO: 765 - protein, 143 aa, Carica papaya
METARTVKDVSPHEFVKAYAAHLKRSGKIELPPWTDIVKTGKFKELAPYDPDWYFVRAASVARKIYLRGGLGVGAFQRIYGGSQRNGSRPPHFCKSSGAIARHILQQLQNMNIIDVDPKGGRRITSSGQRDLDQVAGRIAVAR

SEQ ID NO: 766 - protein, 143 aa, Ananas comosus
MEAARTVKDVSPHEFVKAYSAHLKRSGKMELPEWTDIVKTGRFKELAPYDPDWYYIRAASMARKIYLRQGIGVGGFQKIYGGRKRNGCRPPHFCKSSGAVARHILQQLQSMSIIDVDPKGGRMITSQGRRDLDQVAGRITVVP

SEQ ID NO: 767 - protein, 143 aa, Ananas comosus
METAKTVKDVSPHEFVKAYSAHLKRSGKMELPEWTDIVKTGRFKELAPYDPDWYYIRAASMARKIYLRQGIGVGGFQKIYGGRKRNGCRPPHFCKSSGAVARHILQQLQKMNIIDVDPKGGRAITSQGRRDLDQVAGRIVVVP

SEQ ID NO: 768 - protein, 145 aa, Papaver somniferum
METTAKTVKDVSPHEFVKHYSAHLKRSGKMELPHWTDIVKTAKFKELAPYDADWYYIRAASMARKIYLRQGLGVGCFKKIYGGRKRNGSRPPHFCKSSGSIARHILQQLQDMKIVDLDPKGGRIITSSGRRDLDQVAGRIVVAAP

SEQ ID NO: 769 - protein, 146 aa, Oryza sativa
MADSTARTVKDVNPHEFVKAYSAHLKRSGKMELPEWVDIVKTARFKELPPYDPDWYYTRAASIARKIYLRQGIGVGGFQKIYGGRQRNGSRPPHFCKSSGAISRNILQQLQKMGIIDVDPKGGRLITSQGRRDLDQVAGRVDVTIA

SEQ ID NO: 770 - protein, 155 aa, Secale cereale; identical to SEQ ID NO: 729

SEQ ID NO: 771 - protein, 145 aa, Sorghum bicolor
MAASTARTVKDVNPHEFVKAYSAHLKRSGKMELPEWVDIVKTARFKELPPYDPDWYYTRAASIARKIYLRQGIGVGGFQKIYGGRQRNGSRPPHFCKSSGALSRNILQQLQKMGIIDVDPKGGRLITSQGRRDLDQVAGRVAVEA

SEQ ID NO: 772 - protein, 168 aa, Sorghum bicolor
MAASTARTVKDVNPHEFVKAYSAHLKRSGKVTLHDSLTFPSDSRLHRLFRTAAMELPEWVDIVKTARFKELPPYDPDWYYTRAASIARKIYLRQGIGVGGFQKIYGGRQRNGSRPPHFCKSSGAISRNILQQLQKMGIIDVDPKGGRLITAQGRRDLDQVAGRVAVEA

SEQ ID NO: 773 - protein, 143 aa, Glycine max
MATARTVKDVSPHEFVKAYSSHLKRSGKMELPEWTDIVKTARFKELAPYDPDWYYVRAASMARKIYLRGGLGVGAFQRIYGGSKRNGSRPPHFCKSSGAIARHILQQLQNMNIIELDTKGGRKITSSGRRDLDQVAGRIVVAP

SEQ ID NO: 774 - protein, 143 aa, Glycine max
MATARTVKDVSPHEFVKAYSSHLKRSGKMELPEWTDIVKTARFKELAPYDPDWYYVRAASMARKIYLRGGLGVGAFQRIYGGSKRNGSRPPHFCKSSGAVARHILQQLQNMSIIELDTKGGRKITSSGRRDLDQVAGRIVVAP

SEQ ID NO: 775 - protein, 145 aa, Saccharum officinarum
MAASTARTVKDVNPHEFVKAYSAHLKRSGKMELPEWVDIVKTARFKELPPYDPDWYYTRAASIARKIYLRQGIGVGGFQKIYGGRQRNGSRPPHFCKSSGAISRNILQQLQKMGIIDVDPKGGRLITAQGRRDLDQVAGRVAVEA

SEQ ID NO: 776 - protein, 145 aa, Saccharum officinarum
MAASTARTVKDVNPHEFVKAYSAHLKRSGKMELPEWVDIVKTARFKELPPYDPDWYYTRAASIARKIYLRQGIGVGGFQKIYGGRQRNGSRPPHFCKSSGAISRNILQQLQKMGIIDIDPKGGRLITSQGRRDLDQVAGRVAVEA

SEQ ID NO: 777 - protein, 145 aa, Saccharum officinarum
MAASTARTVKDVNPHEFVKAYSAHLKRSGKMELPEWVDIVKTARFKELPPYDPDWYYTRAASIARKIYLRQGIGVGGFQKIYGGRQRNGSRPPHFCKSSGAISRNILQQLQKMGIIDVDPKGGRLITSQGRRDLDQVAGRVAVEA

SEQ ID NO: 778 - protein, 156 aa, Saccharum officinarum
MAASTERTVNDVNPHEFVKAYSAHLKRSGKMELPEWVDIAKTARFKELPPYDPDWYYTRAASIARKIYLRQGIGVGGFQKIYGGPQRNGFRPPHFLQSIGAISRNILQQLQKMGIIDVESKGGTGYNLPGKGWIWNQLGPKGWLLKQSAVLLIGFQ

SEQ ID NO: 779 - protein, 145 aa, Saccharum officinarum; identical to SEQ ID NO: 777

SEQ ID NO: 780 - protein, 153 aa, Saccharum officinarum
  misc_feature (151)..(151): Xaa can be any naturally occurring amino acid
MAASTARTVKDVNPHEFVKAYSAHLKRSGKMELPEWVDIVKTARFKELPPYDPDWYYTRAASIARKIYLRQGIGVGGFQKIYGGRQRNGSRPPHFCKSSGAISRNILQQLQKMGIIDVDPKGGRLITAQGRRDLDQVAGGLLLKLEQSHLXFQ

SEQ ID NO: 781 - protein, 131 aa, Saccharum officinarum
MAASTARTVKDVNPHEFVKAYSAHLKRSGKMELPEWVDIVKTARFKELPPYDPDWYYTRAASIARKIYLRQGIGVWCFQKITVAARGMAPAHHTSARVVVPFYATFCSSYQRWALLMSIPRADGSSPPREG

SEQ ID NO: 782 - protein, 132 aa, Saccharum officinarum
MAASTARTVKDVNPHEFVKAYSAHLKRSGKMELPEWVDIVKTARFKELPPYDPDWYYTRAASIARKIYLRQGIGVGGFQKIYGGRQRNGSRPPHFCKSSGAISRNILQQLQKMGIIDIDPKGGRLITSQGRA

SEQ ID NO: 783 - protein, 153 aa, Saccharum officinarum
MAASTARTVKDVNPHEFVKAYSAHLKRSGKMELPEWVDIVKTARFKELPPYDPDWYYTRAASIARKIYLRQGIGVGGFQKIYGGRQRNGSRPPHFCKSSGAISRNILQQLQKMGIIDVDPKGGRLITAPGKRDLDQGPEGLLLKLEPSHLRFK

SEQ ID NO: 784 - protein, 194 aa, Saccharum officinarum
PHPHAHYLPLSRSVAAAAGWRHLRRGRRRMSTPTSSSRPTPPTSSAPARWSSLSGLTLTNTARFKELPPYDPDWYYTRAASIARKIYLKQGIGVGGFQKIYGGRQRNGSRPPHFCKSSGAISRNILQQLQKMGIIDVDPKGGRLITSQGRRDLDQVAGRVADEARAVSSEDSMMSCMMAEMATLYLHCGLRFVS

SEQ ID NO: 785 - protein, 145 aa, Saccharum officinarum
MAASTARTVKDVNPHEFVKAYSAHLKRSGKMELPEWVDIVKTARFKELPPYDPDWYYTRAASIARKMYLRQGIGVGGFQKIYGGRQRNGSRPPHFCKSSGAISRNILQQLQKMGIIDVDPKGGRLITSQGRRDLDQVAGRVAVEA

SEQ ID NO: 786 - protein, 145 aa, Saccharum officinarum; identical to SEQ ID NO: 777

SEQ ID NO: 787 - protein, 121 aa, Saccharum officinarum
LKRSGKMELPEWVDIVKTARFKELPPYDPDWYYTRAASIARKIYLRQGIGVGGFQKIYGGRQRNGSRPPHFCKSSGAISRNILQQLQKMGIIDVDPKGGRLITAQGRRDLDQVAGRVAVEA

SEQ ID NO: 788 - protein, 173 aa, Saccharum officinarum
  misc_feature (129)..(129): Xaa can be any naturally occurring amino acid
  misc_feature (146)..(146): Xaa can be any naturally occurring amino acid
  misc_feature (158)..(158): Xaa can be any naturally occurring amino acid
  misc_feature (166)..(166): Xaa can be any naturally occurring amino acid
MAASTARTVKDVNPHEFVKAYSAHLKRSGKMELPEWVDIVKTARFKELPPYDPDWYYTRAASIARKIYLRQGIGVGGFQKIYGGRQRNGSRPPHFCKSSGAISRNILQQLQKMGIIDIDPKGGRLITSXGRRDLDQVAGRVAVEAXAVSSSVSMMSCXMVEMATLXLHFGLGF

SEQ ID NO: 789 - protein, 108 aa, Saccharum officinarum
MAASTASTVKDVNPHEFVKAYSAHLKRSGKMELPEWVDIVKTARFKELPPYDPDWYYTRAASIARKIYLRQGIGVGGFQKIYGGRQKNGSRPPHFCKSSGAILRNILQ

SEQ ID NO: 790 - protein, 145 aa, Saccharum officinarum
MAASTARTVKDVNPHEFVKAYSAHLKRSGKMELPEWVDIVKTARFKELPPYDPDWYYTRAASIARKIYLRQGIGVGGFQKIYGGRQRNGSRPPHFCKSSGAISRNILQQLENMGIIDIDPKGGRLITSQGRRDLDQVAGRVAVET

SEQ ID NO: 791 - protein, 170 aa, Saccharum officinarum
MAASTARTVKDVNPHEFVKAYSAHLKRSGKMELPEWVDIVKTARFKELPPYDPDWYYTRAASIARKIYLRQGIGVGGFQKIYGGRQRNGSRPPHFCKSSGAISRNILQQLQKMGIIDVDPKAGRSYRQEGVIWTKWPEGLLLNLSSLIFGFNDVMFEMAALFLHFWIKVF

SEQ ID NO: 792 - protein, 145 aa, Saccharum officinarum; identical to SEQ ID NO: 777

SEQ ID NO: 793 - protein, 143 aa, Helianthus annuus
MATARTVKDVSPHEFVKGYAAHLKRSGKMELPEWTDIVKTATFKELAPYDPDWYYIRAASIARKIYLRGGLGVGGFQRVYGGRKRNGSAPPHFCKSSGGIIRHILQQLETMKIIDMDPKGGRRITSNGRRDLDQVAGRIVVAP

SEQ ID NO: 794 - protein, 143 aa, Helianthus annuus; identical to SEQ ID NO: 740

SEQ ID NO: 795 - protein, 145 aa, Panicum virgatum
MATSTARTVKDVNPHEFVKAYSAHLKRSGKMELPEWVDIVKTARFKELPPYDPDWYYTRAASIARKIYLRQGIGVGGFQKIYGGRQRNGSCPPHFCKSSGAISRNILQQLQKMGIIDVDPKGGRLITSQGRRDLDQVAGRVAVEA

SEQ ID NO: 796 - protein, 145 aa, Panicum virgatum
MAASTARTVKDVNPHEFVKAYSAHLKRSGKMELPEWVDIVKTARFKELPPYDPDWYYTRAASIARKIYLRQGIGVGGFQKIYGGRQRNGSRPPHFCKSSGAISRNILQQLQKMGIIDVDPKGGRLITSQGRRDLDQVAGRVAVDA

SEQ ID NO: 797 - protein, 145 aa, Panicum virgatum; identical to SEQ ID NO: 796

SEQ ID NO: 798 - protein, 145 aa, Panicum virgatum; identical to SEQ ID NO: 796

SEQ ID NO: 799 - protein, 145 aa, Panicum virgatum
MATSTARTVKDVNPHEFVKAYSAHLKRSGKMELPEWVDIVKTARFKELPPYDLDWYYTRAASIARKIYLRQGIGVGGFQKIYGGRQRNGSCPPHFCKSSGAISRNILQQLQKMGIIDVDPKGGRLITSQGRRDLDQVAGRVAVEA

SEQ ID NO: 800 - protein, 145 aa, Camellia sinensis
MEAARTVKDVSPHEFVKAYAAHLKRSGKMELPHWTDIVKTAKFKELAPYDPDWYYIRAASMARKIYLRGGLGVGAFQRIYGGSQRNGSRPPHFCKSSGAIARHILQQLQNMNIVDFDSKGGRKITSSGQRDLDQVAGRIVAVVAQ

SEQ ID NO: 801 - protein, 143 aa, Juglans hindsii x Juglans regia
MATATTVKDVSPHEFVKAYSAHLKRSGKMELPEWADIVKTARFKELAPYDPDWYYVRAASMARKIYLRGGLGVGSFRRIYGGSQRNGSRPPHFCKSSGSVARHILQQLQQMNIIDVDPKGGRRITSTGQRDLDQVAGRIVVAP

SEQ ID NO: 802 - protein, 143 aa, Juglans hindsii x Juglans regia
MATATTVKDVSPHEFVKAYSAHLKRSGKMELPEWSDIVKTAKFKELAPYDPDWYFVRAASMARKIYLRGGLGVGSFQRIYGGSQRNGSRPPHFCKSSGAVARHILQQLQKMNIIDVDPKGGRRITSTGQRDLDQVAGRIVVAP

SEQ ID NO: 803 - protein, 155 aa, Triticum aestivum
MATVPAPAAETAASTARTVKDVNPHEFVKAYSAHLKRSGKMELPEWVDIVKTARFKELPPSDADWYYIRAASMARKIYLRQGIGIGGFQKIYGGRQRNGSRPPHFCKSSGAVSRNILQELQKMGIIDVDPKGGRLITSQGRRDLDQVAGTVPAEF

SEQ ID NO: 804 - protein, 155 aa, Triticum aestivum; identical to SEQ ID NO: 803

SEQ ID NO: 805 - protein, 155 aa, Triticum aestivum; identical to SEQ ID NO: 803

SEQ ID NO: 806 - protein, 145 aa, Triticum aestivum; identical to SEQ ID NO: 771

SEQ ID NO: 807 - protein, 146 aa, Triticum aestivum; identical to SEQ ID NO: 769

SEQ ID NO: 808 - protein, 504 aa, Brassica napus
MNLYPNLRRGTLLSVLYVVVLLCNASTSTSYSSSEAITIKPRHLSLLKSALQRPSGEQSDLWKPMTDQGWSPCIDLEDPPSLPDKTKSYIQVFLDGGLNQQRMGICDAVAVAKILNATLVIPFLEINPVWQDSSSFVDIFDVDHFIDALKDDVRVVKELPEDYSWSTREYYAAAVRETRVKTAPVHASAQWYIENVSPLLHSYGIAAISPFSHRLSFDHLPGEIQRLRCKVNFQALRFVPHITSLGDALVSRLRNPLWRSEKDRKSVDHLGDMTNPNSRHEPGKFAVLHLRFDKDMAAHSACDFGGGKAEKLALAKYRQMIWQGRVLNSQFTDEELRSQGRCPLTPEEMGLLLAAFGFDNNTRLYLASHKVYGGEARISALRQVFPRMEDKRSLASSEERARIKGKASLLAALDYYVSMHSDVFISASPGNMHNALVGHRTFENLKTIRPNMALIGQLFLNKSITWVDFQQAIGEGHVNRQGQIRLRKPKQSIYTYPAPDCMCH

SEQ ID NO: 809 - protein, 503 aa, Raphanus sativus
  misc_feature (81)..(81): Xaa can be any naturally occurring amino acid
MSLYAKDRTILSALLFVVVLICNASTSSSASEAITIKPRHLSLLKSALQRPSGEQSELWRPMPDQGWSPCLDLGNSPSLPXKSEGYIQVFLDGGLNQQRMGICDAVAVAKILNATLVIPYLEVNPVWQDSSSFVDIFDVDHFINSLKDDIRVVRELPEELSWSTREYYSIAVRETRVKTAPVHASAKWYKENVSPVLQSYGIAAISPFSHRLSFDHLPAEIQRLRCKVNFQALRFVPHITSLGDALVSRLRNPLWRSSKDRKKNVDHLGDMTNSHSRREPGKFAVLHLRFDKDMAAHSACDFGGGKAEKLALAKYRQMIWQGRVLNSQFTDEELRSQGRCPLTPEEMGLLLAAFGFDNNTRLYLASHKVYGGEARISALRQVFPRMEDKRSLASSEERARIKGKASLLAALDYYVSMHSDIFISASPGNMHNALVGHRTFENLKTIRPNMALIGQLFLNKSITWVDFQQALGEGHVNRQGQIRLRKPKQSIYTYPAPDCMCHV

SEQ ID NO: 810 - protein, 171 aa, Raphanus sativus
  misc_feature (4)..(4): Xaa can be any naturally occurring amino acid
  misc_feature (24)..(24): Xaa can be any naturally occurring amino acid
  misc_feature (51)..(51): Xaa can be any naturally occurring amino acid
  misc_feature (162)..(162): Xaa can be any naturally occurring amino acid
MENXLGLLRLHVIRGVNLAIRDSXSSDPYVIVRMGQQKLRTRVVKKNLNPXWNEDLTLSISDPTLPIKIMVYDRDWLSRDDKMGDAVFHIDPFLEVIRMKNQFGGLPEGTVIMKIQASRQNCLSEESKIVWNKGKIVQNMFLRLQNVECGEVELQLEWIDVXGLEHEDVAY

SEQ ID NO: 811 - protein, 511 aa, Arabidopsis thaliana
MEILTSMAIIVVTTIFILLSFALYLTIRIFTGKSRNDKRYTPVHATIFDLFFHSHKLYDYETEIARTKPTFRFLSPGQSEIFTADPRNVEHILKTRFHNYSKGPVGTVNLADLLGHGIFAVDGEKWKQQRKLVSFEFSTRVLRNFSYSVFRTSASKLVGFIAEFALSGKSFDFQDMLMKCTLDSIFKVGFGVELGCLDGFSKEGEEFMKAFDEGNGATSSRVTDPFWKLKCFLNIGSESRLKKSIAIIDKFVYSLITTKRKELSKEQNTSVREDILSKFLLESEKDPENMNDKYLRDIILNVMVAGKDTTAASLSWFLYMLCKNPLVQEKIVQEIRDVTSSHEKTTDVNGFIESVTEEALAQMQYLHAALSETMRLYPPVPEHMRCAENDDVLPDGHRVSKGDNIYYISYAMGRMTYIWGQDAEEFKPERWLKDGVFQPESQFKFISFHAGPRICIGKDFAYRQMKIVSMALLHFFRFKMADENSKVSYKKMLTLHVDGGLHLCAIPRTST

SEQ ID NO: 812 - protein, 81 aa, Arabidopsis thaliana
MGITKTSVTFLFLLILAAFVSNYNVLASEIKPTGRIDDQCKQMCSATYGDGKCASDCRKAGFSSGRCLTSSPFGNKCCCTK

SEQ ID NO: 813 - protein, 682 aa, Ricinus communis
MEAPPGGSDREKSNPSSSPIPVVSNFWKEFDLEKEKIVLDEQGLRIAENQENSLKNRRKLAESTRDFKKASPEEKLSLFNSLLKGYQEEVDNLTKRAKFGENAFLNIYQKLYEAPDPYPALASIADQDLKLSELESENRKMKVELEEFRTEATHLKNQQATIRRLEDRNRQLEQQMEEKVKEIVEMKQRSLAEENQKTLEVLKEREQSLQDQLRQAKESVSNMQKLHELAQSQLFEVHAQSEEERAAKQSEVNLLMDEVERAQTRLLSLEREKGVLRSQLQSANEETGNKKSDSLDSNNVLENTLSAKEKIISELNMELHNIETALTNEREQHINEIKKLNMVLNEKELSIEEMKKELQARPTAKLVDDLRKKVKILQAVGYNSIEAEDWEAATSGEEMSKMESLLLDKNRKMEHELTHLKVKLSEKESTLETAESKIVELSAKVNEQQKLIQKLEDDILKGYSSKDQKGGLFDDWDLSEAGRVELSENADQKHVSSDQDQSSMLKVICNQRDRFRKRLRETEEEVRQLKEKIGLLTAELEKSKADNVKLYGKIRYVQDYNLEKVVSRGSKKQAEDLESGFSSDVESKYKKIYEDDINPFAAFSKKERDQRYKELGLRDRITLSSGRFLLGNKYARTFAFFYTIGLHILVFTCLYRMSALSYLSHGEESYTGEKQLNLPHAL

SEQ ID NO: 814 - protein, 682 aa, Gossypium hirsutum
MDAPQGGSDGDKTNPSSSPVSVVSNFWKEFDLEKEKSVLDEQGLRIAENQENSQKNRRKLAESTRDFKKAAPEEKLSLFNSLLKGYQEEVDNLTKRAKFGENAFLNIYQKLYEAPDPYPALASISEQDLKISELESENRKVKVELEEFRTESMHLKNQQATIRRLEERNRQLEQQMEEKVKEIVEMKQRSLAEENQKTLEVLKDREQSLQDQLRQAKESVSNMQKLHELAQSQLFELRAQSEEDRAAKQSEVNLLMDEVERAQTRLFSLEREKGLLRSQLQSANEESENKRSDVDSNAILETSLSSKEKIISELNMELHNIETTLSNERVQHVNEIKKLNSLLNEKDVALEEMKKELKARPTEKLVDDLRKKVKILQAVGYNSIEAEDWEAATSGEEMSKMESLLLDKNKKMEHELTQLKVKLSEKTSFLETAEGKIVELAEKVNEQQKLIQKLEDDILKGYSSKEKKGTLFDDWDLSESGGNELSENTDQKQVSADQDQSSMLKVICNQRDRFRARLRETEEEIRQLKEKIGELTTELEKTKADNVKLYGKIRYVQDYNQEKVISRGSKKYAEDLESGFTSDVESKYKKIYEDDINPFAAFSKKERDQRYKELGFRDRITLSSGRFLLGNKYARTFAFFYTIGLHILVFTCLYRMSALSYLSHGSEETAVVEKNLNLPRGY

SEQ ID NO: 815 - protein, 690 aa, Glycine max
MEAPQGGSGSGPERDKSTAPSSSPISVVSAFWKDFELEKEKSILDEQGLRIAENQESSQKNRRKLAENTRDFKKASPEDKLSLFNSLLKGYQEEVDNLTKRAKFGENAFLNIYQKLYEAPDPYPALASIAEQDLKISELESENRKMKVELEEFRTEATHLKNQQATIRRLEERNRQLEQQMEEKVKEIVEIKQRSLAEENQKTLEVLKEREQALQDQLQHAKDSVSTMQKLHELAQNQLFELRAQSEEERASKQSEVNLLMDEVERAQSMLLSLEREKGVLRSQLQTANEETETKNSDNFDSNSALENSLNAKEKQISELNMELHNIETALSNERDQHINEVKKLTAMLNEKEAALEEMKKELKARPTEKMVDDLRKKVKILQAVGYNSIEAEDWEVATSGEEMSKMESLLLDKNRKMEHELTQLKVTLSEKTSLLETAEQKIAELTAKVNEQQKLVQKLEDDILKGYSSNSKDRKGNFLDDWDLSEAGGGEVSENTDQRQVSLDQDQSSMLKVICNQRDRFRTRLRETEEEIRQLKEKIGVLTVELEKSKADNVKLYGKIRYVQDYNHEKVISRGSKKYAEDLESGFASDVESKYKKIYEDDINPFAAFSKKERDQRYKELGFRDRITLSSGRFLLGNKYARTFAFFYTIGLHILVFTCLYRMSALSYLSNGPEEFLVGEKNVDLPRGP

SEQ ID NO: 816 - protein, 692 aa, Glycine max
MEAPPGGSGSGSGPERDKSTAPSSSPISVVSAFWKDFELEKEKSILDEQGLRIAENQENSQRNRRKLAENTRDFKKASPEDKLSLFNSLLKGYQEEVDNLTKRAKFGENAFLNIYQKLYEAPDPYPALVSIAEQDLKISELESENRKMKVELEEFRTEATHLKNQQATIRRLEERNRQLEQQMEEKVKEIVEIKQRSLAEENQKTMEVLKEREQALQDQLQHAKDSVSTMQKLHELAQNQLFELRAQSEEERASKQSEVNLLMDEVERAQSMLLSLEREKGVLRNQLQTANEETETKNSDNFDSNSALENSLNAKEKQISDLNMELHNIETALSNERDQHINEVKKLTAMLNEKEAALEEMKKELKARPTEKMVDDLRKKVKILQAVGYNSIEAEDWEVATSGEEMSKMESLLLDKNRKMEHELTQLKVTLSEKTSILETAEQKIAELTAKSNEQQKLIQKLEDDILKGYSSNSKDRKGNFLDDWDLSEAGGGEVSENTDQRQVSLDQDQSSMLKVICNQRDRFRTRLRETEEEIRQLKEKIGVLTVELEKSKVDNVKLYGKIRYVQDYNHEKVVSRGSKKYAEDLESGFMSDVESKYKKIYEDDINPFAAFSKKERDQRYKELGFRDRITLSSGRFLLGNKYARTFAFFYTIGLHILVFTCLYRMSALSYLSNGPEEFLVGEKNVDLPRGP

SEQ ID NO: 817 - protein, 447 aa, Brassica napus
  misc_feature (47)..(47): Xaa can be any naturally occurring amino acid
  misc_feature (354)..(354): Xaa can be any naturally occurring amino acid
REESSLLSLSLSLSLGLTETMQSGGDYTNGFHGELQREEKQVPVLSXLGRAKRRSRGGARDPRGGLTNGELRVSDQISEQKPLETQESPPPCTDFDVAYFHSYAHVGIHEEMIKDRSRTETYREAIMQHQSFIQGKVVVDVGCGTGILSIFCAQAGAKRVYAVDASDIAVQANEVVKANGLSDKVIVLHGRVEDVEIDEEVDVIISEWMGYMLLYESMLGSVITARDRWLKPGGLILPSHATLYMAPISHPDRYSHSIDFWRNVYGIDMSAMMQLAKQCAFEEPSVESISGETVLTWPEVVKHIDCQTIKIQELDSVTARYKFKSMMRAPMHGFAFWFDVEFSEPAKNTNATSXANGSSSISPFTEGNQKKRSNPSDALVLSTSPEAPPTHWQQTIVYFYDPIDVEQDQVIEGSVTLSQSKENRRFMNIHLEYSSAGRSFVKESVMR

SEQ ID NO: 818 - protein, 498 aa, Raphanus sativus
  misc_feature (171)..(171): Xaa can be any naturally occurring amino acid
  misc_feature (360)..(360): Xaa can be any naturally occurring amino acid
  misc_feature (423)..(423): Xaa can be any naturally occurring amino acid
  misc_feature (440)..(440): Xaa can be any naturally occurring amino acid
  misc_feature (443)..(443): Xaa can be any naturally occurring amino acid
METKALIFTVLFIVLTLRFLIRKLKRHPNLPPSPPWSLPVIGHLRLLKPPIHRTFLSISQSLGDAPIFSLRFGNRLVFVNSSHSIAEECFTKNDVVLANRPNFILANYVAYDYTTVIAASYGDHWRNLRRIGSLEIFSNHRLNSFLSIRKDEIRRLILRLSRNFSQEFAKXEMKSMLSDLTFNNIIRMVAGKRYYGDGVEEDPEAKQVRQLIADVVTLAGAGNAVDYLPFLRWVSDYEKRVKKLSARLDEFLQRLVDEKREAKEKGNTMVDHLLSLQETQPGYFTDRIIKGNMLSLILAGTDTSAVTLEWALSNLLNHPEVLKKARDEIDRKVGLDRLIDESDISNLPYLQNIVSETLRXYPAVPMLLPHVASEDCKVGGYDMPSGTILLTNAWAIHRDPQLWEDPTSFKPERFEKEGESQKXMAFGLGRRACPGSGLAXRLXNLTLGSLIQCLEWERLGEEKVDMSERKGGTMPKAKPLEAMCRARASVGKIFHEGA

SEQ ID NO: 819 - protein, 559 aa, Arabidopsis thaliana
MNFNSSYNLTFNDVFFSSSSSSDPLVSRRLFLLRDVQILELLIAIFVFVAIHALRQKKYQGLPVWPFLGMLPSLAFGLRGNIYEWLSDVLCLQNGTFQFRGPWFSSLNSTITCDPRNVEHLLKNRFSVFPKGSYFRDNLRDLLGDGIFNADDETWQRQRKTASIEFHSAKFRQLTTQSLFELVHKRLLPVLETSVKSSSPIDLQDVLLRLTFDNVCMIAFGVDPGCLGPDQPVIPFAKAFEDATEAAVVRFVMPTCVWKFMRYLDIGTEKKLKESIKGVDDFADEVIRTRKKELSLEGETTKRSDLLTVFMGLRDEKGESFSDKFLRDICVNFILAGRDTSSVALSWFFWLLEKNPEVEEKIMVEMCKILRQRDDHGNAEKSDYEPVFGPEEIKKMDYLQAALSEALRLYPSVPVDHKEVQEDDVFPDGTMLKKGDKVIYAIYAMGRMEAIWGKDCLEFRPERWLRDGRFMSESAYKFTAFNGGPRLCLGKDFAYYQMKSTAAAIVYRYKVKVVNGHKVEPKLALTMYMKHGLMVNLINRSVSEIDQYYAKSFDEGYIN

SEQ ID NO: 820 - protein, 267 aa, Malus domestica
MEGSANERLDFGKMGYGCKHYRRRCQIRAPCCNEIHPCRHCHNEATSMLSNPFDRHELVRYDVKQVVCSVCDTEQPVAKVCTNCGISMGEYFCDICKFYDDDTTKEQFHCNDCGICRIGGRDKFFHCKKCGSCYSIRLRDNHLCVENSMRHHCPICYEFLFDSLKDTTVMKCGHTMHRECYNEMMQRDKYCCPICSKSVIDMSRTWQRIDEEIEATVMPEDYRYKKVWILCNDCNDTTEVYFHIIGQKCNHCNSYNTRTIAPPVLPQ

SEQ ID NO: 821 - protein, 267 aa, Malus domestica
MEGSADERLEFGKMGYGCKHYRRRCQIRAPCCNEIYPCRHCHNEATSMLSNPFDRHELVRYDVKQVVCSVCDTEQPVARVCTNCGVSMGEYFCDICKFYDDDTTKEQFHCNDCGICRIGGRDKFFHCKKCGSCYSNGLRDNHLCVENSMRHHCPICYEFLFDSLKETTVMKCGHTMHCECYNEMMKRDKYCCPICSKSVIDMSKTWKRIDEEIEATVMPEDYRYKKVWILCNDCNDTTEAYFHIIGQKCNHCNSYNTRTIAPPVLPQ

SEQ ID NO: 822 - protein, 267 aa, Brassica rapa
  misc_feature (228)..(228): Xaa can be any naturally occurring amino acid
MEASPNDRLHFGVMAFGCDHYNRRCQIRAPCCNEVFSCRHCHNESTSTLRNIYDRHELVRQDVKQVICSVCDTEQPVAQVCTNCGVNMGEYFCDICKFYDDNTAKEQFHCDDCGICRVGGRENFFHCKKCGSCYAIGLRNNHRCVEDSMRHHCPICYEYLFDSLKDTTVMKCGHTMHFECYHEMLKRDKFCCPICSRSVIDMSKTWQRMDEEIEATSMPSDYRDKKVXILCNDCNDTTEVNFHIIGQKCGHCRSYNTRAIGPPVLPQ

SEQ ID NO: 823 - protein, 268 aa, Theobroma cacao
MEASSANERLHFGKMGYGCQHYRRRCEIRAPCCNEVFSCRHCHNEAASMLRNPFDRHDLVRQDVKQVICSVCDTEQPVAKLCSNCGVNMGEYFCEICKFFDDDTEKGQFHCHDCGICRVGGRENFFHCKKCGSCYSIALRDNHSCVENSMRHHCPICYEYLFDSLKDTTVMKCGHTMHCECYHEMIKRDKYCCPICSKSVIDMSRIWKRIDEEIEATVMPEDYRYKKVWILCNDCNDTTEVYFHIIGQKCSHCKSYNTRTIAPPVLPQ

SEQ ID NO: 824 - protein, 267 aa, Brassica napus
  misc_feature (153)..(153): Xaa can be any naturally occurring amino acid
MEASPNDRLHFGVMAFGCDHYNRRCQIRAPCCNEVFPCRHCHNESTSTLRNISDRHELVRQDVKQVICSVCDTEQPVAQVCTNCGVNMGEYFCDICKFYDDNTAKEQFHCDDCGICRVGGRENFFHCKKCGSCYAIGLRNNHRCVEDSMRHHXPICYEYLFDSLKDTTVMKCGHTMHFECYHEMLKRDKFCCPICSRSVIDMSKTWQRMDEEIEATSMPSDYRDKKVWILCNDCNDTTEVNFHIIGQKCGHCRSYNTRAIGPPVLPQ

SEQ ID NO: 825 - protein, 275 aa, Brassica napus
MEDSPNDRLHFGIMGFGCEHYRRRCQIRAPCCNEVFPCRHCHNETTTILPLLKQSTLRNIFDRHELVRQDVKHVICSVCDTEQPVAQVCSNCGVNMGEYFCNICKFYDDNTEKEQFHCDDCGICRVGGRENFFHCKKCGSCYGIGLRNNHRCVEDSMRHHCPICYEYLFDSLKETTVMKCGHTMHCDCYHEMLKRDKFCCPICSRSVIDMSKTWQRMDEEVEAISMPSDYRDKKVWILCNDCNDTTQVYFHIIGQKCGHCRSYNTRAVAPPVLPQ

SEQ ID NO: 826 - protein, 269 aa, Ricinus communis
MEATTQSCGRLDFGKMGYGCEHYRRRCRIRAPCCNEIFWCRHCHNESASTLKNLCDRHEINRFDVKQVICSVCDTEQPVAQVCTNCGVNMGEYFCGVCKFFDDDTDKGQFHCDDCGICRVGGRENYFHCSKCGSCYAISLLGNHSCVENSMRHHCPICYEYLFDSLKDTTVMKCGHTMHFECYNEMIERDKYCCPICSKSVIDMSKTWKRIDEEIEATVMPEDYRYKKVWILCNDCNDTTEVYFHIIGQKCSHCKSYNTRTIAPPVLPQ

SEQ ID NO: 827 - protein, 267 aa, Citrus sinensis
MEGSANERITFGKMGYGCKHYRRRCKIRAPCCNEIFDCRHCHNEAASMLRNPYDRHELVRQDVKQVICSVCDTEQPVAQVCTNCGVNMGEYFCDICKFYDDDIEKGQFHCDDCGICRIGGRENYFHCKRCGSCYSTSLRNNHLCIENSMHHHCPICYEYLFDSLRNTTVMKCGHTMHCECYHEMIKRDKYCCPICSKSVIDMSRTWKRIDEEIEATVMPEDYRHKKVWILCNDCNDTTEVYFHIIGQKCSHCKSYNTRSIAPPVLPQ

SEQ ID NO: 828 - protein, 268 aa, Gossypium hirsutum
MEASSANQRLHFGKMGYGCQHYRRRCKIRAPCCNEVFSCRHCHNEAVNLLSNPFDRHELVRKDVKQVICSVCDTEQPVAQLCSNCGVNMGEYFCKICNFFDDDTEKGQFHCDDCGICRVGGRENFFHCKKCGSCYSVALRGNHTCVENSMQHHCPICYEYLFDSLKDTTVMKCGHTMHYECYHEMLKRDKYCCPICSKSVIDMSRAWKRMDEEIEATLMPEDYRYKKVWILCNDCDDTTEVYFHIIGQKCSHCRSYNTRTIAPPELPQ

SEQ ID NO: 829 - protein, 268 aa, Gossypium hirsutum
MEASSANERLHFGKMGYGCQHYRRRCKIRAPCCNEVFWCRHCHNEASSMLKNPMDRHEIVRQDVKQVICSVCDTEQPVAQLCSNCGVNMGEYFCAICMFFDDDTEKEHFHCHDCGICRVGGRDNFFHCKKCGSCYAIALRDNHLCVENSMRHHCPICYEYLFDSLKDTTVMKCGHTMHCECYDEMIKRNKYCCPICSKSVIDMSRTWKRIDEEIEATVMPEDYRHKKVWILCNDCNDTTEVYFHIIGQKCSHCKSYNTRTIAPPILPH

SEQ ID NO: 830 - protein, 267 aa, Vigna unguiculata
MERSVLERLDFGKMGYGCKHYRRRCRIRAPCCNELYSCRHCHNDATSMLSKPLDRHELVRQDVEHVVCSVCDTEQPVAQVCTNCGVRMGEYFCSICKFFDDETGKEHFHCDDCGICRVGGRENFFHCKKCGSCYSNGLRDNHLCVENSMRHHCPICYEYLFDSLKDTAVMKCGHTMHSECYHEMIKRDQYCCPICSKSVIDMSRTWKRIDEEIEATVMPEDYQNRKVWILCNDCNDTTEVYFHIIGHKCGHCNSYNTRAIAPPVLPQ

SEQ ID NO: 831 - protein, 267 aa, Vitis vinifera
MEGSADERLDFGKMGFGCKHYRRRCRIRAPCCNEIFPCRHCHNEATSMLRNPFDRHELVRHDVKQVICAVCDTEQPVAQVCTNCGVNMGEYFCEVCKFYDDDTTKGQFHCDDCGICRVGGRDKFFHCKKCGCCYSVGLRDNHSCVENSMRHHCPICYEYLFDSLKDTTVMVCGHTMHCECYNEMVSHDKYCCPICSKSVRDMTRTWKRIDEEIEATIMPEDYQHKKVWILCNDCNDTTEVFYHIIGQKCSHCKSYNTRIVAPPVLPQ

SEQ ID NO: 832 - protein, 268 aa, Ipomoea nil
MEGSSDDRLGFGKMGYGCQHYRRRCKIRACCCNEVYGCRHCHNEEASMLRNPFDRHELNRHEVKQVICSVCDTEQPVAQVCTNCGVKMGEYFCKICNFFDDDIEKGQFHCDDCGICRVGGRDNFFHCKKCGSCYAISLRNNHSCVENSMRHHCPICYEYLFDSLKDTTVMKCGHTMHYECFYEMIKRDKFCCPICSKSIIDMSSIWKEMDEEIEQTTMPDDYRDRKVWILCNDCNDTTEVLFHIIGQKCRHCQSYNTRTIAPPVLPNP

SEQ ID NO: 833 - protein, 268 aa, Lactuca sativa
MAGPNDERLDFGKMGYGCKHYRRRCMIRAPCCNEIFDCRHCHNEATNMLKNPYDRHELIRSDVKQVICSVCDTEQPVARSCTNCGVNMGEYFCELCKFYDDDIDKGLFHCDDCGICRVGGRENFFHCKKCGTCYSIGLRDNHLCVENSMRHHCPICYEYLFDSMKDTAVMKCGHTMHRDCYNEMIKRDKFCCPICAKSIMDMSATWKMIDEEIEATLMPDDYRHKKVWILCNDCNDTTEVFFHIIGQKCRHCRSYNTRTIAPPVLHKN

SEQ ID NO: 834 - protein, 267 aa, Medicago truncatula
MEASAIERLDFGKMGYGCKHYRRRCRIRAPCCNEVYSCRHCHNEATSMLKNPFDHHELVRNDVEQVVCSVCDTEQPVAQVCTNCGVRMGEYYCDLCKFFDDDTGKQQFHCEDCGICRVGGSENYFHCKKCGSCYSVALRDNHLCVENSMRHHCPICYEYLFDSLKDTTVMKCGHTMHCECYHEMIKRDKYCCPICSKSVIDMSTAWKRIDEEIEATVMPDDYRNRKVWILCNDCNDTTEVSFHIIGHKCGHCSSYNTRAIAPPVLPQ

SEQ ID NO: 835 - protein, 267 aa, Prunus persica
MGGSGNERLDFGKMGYGCKHYRRRCQIRAPCCNEIYPCRHCHNEATSMLSNPFDRHELVRYDVKQVVCSVCDTEQPVARVCTNCGVSMGEYFCEICKFYDDDTDKGQFHCNDCGICRIGGRENFYHCKKCGSCYSVGLRDNHLCVENSMRHHCPICYEFLFDSLKDTTVMKCGHTMHCECYNEMMKRDKYCCPICSKSVIDMSRTWRRIDEEIEATAMPEDYRYKKVWILCNDCNDTTEVYFHIIGQKCNHCKSYNTRTIAPPVLPQ

SEQ ID NO: 836 - protein, 269 aa, Populus trichocarpa
MESTPVSNERLDFGKMGYGCQHYRRRCQIRAPCCNEIFTCRHCHNEATNMLKNFCDRHELNRYDVKQVICAVCDTEQPVAQVCTNCGVNMGEYFCEICKFFDDDTAKGQFHCDDCGICRVGGRENYFHCKKCGSCYATSLLDNHSCVENSMRHHCPICYEYLFDSLKETTVMKCGHTMHGECYDEMIKRDKYCCPICSKSIIDMSKTWERIDEEIEATVMPEDYSHRKVWILCNDCNDTTEVYFHIIGQKCSHCKSYNTRTIAPPVLPQ

SEQ ID NO: 837 - protein, 267 aa, Prunus persica; identical to SEQ ID NO: 835

SEQ ID NO: 838 - protein, 267 aa, Raphanus sativus
  misc_feature (10)..(10): Xaa can be any naturally occurring amino acid
  misc_feature (20)..(20): Xaa can be any naturally occurring amino acid
MEASPNDRLXFGKMGFGCQXYRRRCQIRAPCCNEVFDCRHCHNEFTSTLRNIYDRHELVRQDVKQVICSVCDTEQPVAQICSNCGVNMGEYFCNICKFYDDNTEKQQFHCDDCGICRVGGRENFFHCKKCGSCYATGLRNNHRCVEDSMRHHCPICYEYLFDSLKETTVMKCGHTMHCECYHEMIKRDKFCCPICSRSVIDMSKTWQRMDEEIEATSMPSDYRDKKVWILCNDCNDTTEVYFHIIGQKCGHCRSYNTRAVAPPVLPQ

SEQ ID NO: 839 - protein, 267 aa, Raphanus sativus
MEASPNDRLHFGIMGFGCDHYNRRCQIRAPCCNEVFPCRHCHNESTSTLRNIYDRHELVRQDVKQVICSVCDTEQPVAKVCTNCGVNMGEYFCDICKFYDDNTEKEQFHCDDCGICRVGGRENFFHCKKCGSCYAIGLRNNHRCVEDSMRHHCPICYEYLFDSLKDTTVMKCGHTMHCECYQEMLKRDKFCCPICSRSVIDMSKTWQRMDEEIEATSMPSDYRDKKVWILCNDCNDTTEVYFHIIGQKCGHCRSYNTRAVAPPVLPQ

SEQ ID NO: 840 - protein, 267 aa, Glycine max
MEGSVLERLDFGKMGYGCKHYRRRCRIRAPCCNELYSCRHCHNEATSMLSNPFDRHELVRQDVEHVVCSVCDTEQPVAQVCTNCGVRMGEYFCSICKFFDDDTGKQQFHCDDCGICRIGGRENYFHCNKCGSCYSTSLRDNHMCVENSMRHHCPICYEYLFDSLKDTAVMKCGHTMHSECYLEMLKRDKYCCPICSKSVMDMSRAWKRIDEEIEATVMPDDYRYRKVWILCNDCNDTTEVYFHVLGQKCGHCSSYNTRAIAPPVLPQ

SEQ ID NO: 841 - protein, 267 aa, Glycine max
MEGSVNERLDFGKMGYGCNHYRRRCRIRAPCCNEIYSCRHCHNDAASLLKNPFDRHELVRQDVKQVVCSVCDTEQPVAQVCTNCGVKMGEYFCNICKFFDDDVEKEQFHCDDCGICRVGGRDNFFHCKKCGSCYAIGLRDNHLCVENSMRHHCPICYEYLFDSLKDTIVMKCGHTMHHECYVEMIKNDKYCCPICSKSVIDMSKTWKRIDEEIEATVMPEDYRNRKVWILCNDCNDTTEVYFHILGQKCGHCRSYNTRAVAPPVLPQ

SEQ ID NO: 842 - protein, 267 aa, Glycine max
MEGSVNERLHFGKIGYGCNHYRRRCRIRAPCCNEIYSCRHCHNEAASLLKNPFDRHELVRQDVKQVICSVCDTEQPVAQVCTNCGVKMGEYFCNICKFFDDDVEKEQFHCDDCGICRVGGRDNFFHCKKCGSCYAVGLHDNHLCVENSMRHHCPICYEYLFDSLKDVIVMKCGHTMHHECYLEMIKNDKYCCPICSKSVIDMSKTWKRIDEEIEATVMPQDYRNRKVWILCNDCNDTTEVYFHILGQKCGHCRSYNTRTVAPPVLPQ

SEQ ID NO: 843 - protein, 267 aa, Fragaria vesca
MEASGNERRSFGKMGYGCKHYRRRCRIRAPCCNEIYPCRHCHNEATSMLSNPFDRHELVRHDVKQVICSVCDTEQPVARDCTNCGVSMGEYFCDICKFYDDDTEKGQFHCDDCGICRIGGRENFYHCKKCGSCYSISLLDNHLCVENSMRHHCPICYEFLFDSLKDTTVMKCGHTMHCECYNEMIKRDKYCCPICSKSVIDMSRTWKRIDEEIEATVMPEDYRNKKVWILCNDCNDTTEVFFHIIGQKCNHCKSYNTRTIAPPVLPQ

SEQ ID NO: 844 - protein, 267 aa, Thellungiella halophila
  misc_feature (231)..(231): Xaa can be any naturally occurring amino acid
MEASPNDRLHFGKMGFGCEHYRRRCLIRAPCCNEVFACRHCHNESTSTLRNIYDRHELVRQDVKQVICLVCDTEQPVAQVCSNCGVKMGEYFCNICKFYDDNTEKQQFHCDDCGICRIGGRENFFHCKKCGSCYAIGLRNNHRCVENSMRHHCPICYEYLFDSLKDTTVMKCGHTMHCECYHEMIKRDKFCCPICSRSVIDMSKTWLRMDEEIEATAMPSDYRDKKVWILXNDCNDTTEVYFHIIGQKCGHCRSYNTRAIGPPVLPQ

SEQ ID NO: 845 - DNA, 1052 bp, Arabidopsis thaliana
ggatccgaaccatgatgaatctttcttctcgtcgcgcctcttccactctcacattgagcttcactgttctccttttagcttccacaggttcgtatggctcaacattcacattcgctaatcggtgcggctacaccgtatggcctggaatcctatcgaatgctggctcacctactctctccaccaccggatttgagctccctaaaggcacctctcgctctctccaagctcccaccggttggtccggtcgattctgggctcgtaccggttgcaagttcgacagttctggctccggtacatgcaaaaccggtgactgcggctccaactctgtcgaatgcgccgggcttggtgccgcaccgcctgtaactctcgcggagttcactctaggcactggcggcgatgatttctacgacgttagtctcgtcgacggttacaacattccgatgatagttgaagtcgccggtggatctgggcagtgcgcttctaccggatgcactacggatcttaacattcagtgccctgctgagctgcgtttcggcgacggagacgcttgcaaaagcgcgtgtttagcgtttcggagtcctgaatactgttgcagcggcgcgtatgctacaccttctagttgtcggccttccgtgtattcggagatgtttaaagccgcgtgtcctcgctcctatagctacgcttacgacgatgctacgagcactttcacttgcgccggtggagattatacggtgacgttttgcccttcttcccctagtcaaaaatcgactagctactcccctccagtgacagactcgtcgtcgacctcacaaggttccgatcctgtgcctggttctgatactggttacgctggtcagggtcaacagactccaggtcaaggtaatgtgtacgggtcacaggggactgggtcggagatgggtacgggtgagaccatgttacaagacggatcatggatggctggtttggccatgggagaggcaagcagaccagccggcgtttcattgacagtgctgcttgctgcatttacttttccgtttattttctcgtagtaa

SEQ ID NO: 846 - DNA, 1699 bp, Arabidopsis thaliana
agattgcgtcactgtagtagtagtagtaatgtctcttcttcttctcttctgttgcttctttacctctctttctatttctcattctcatggagcttccactattcacatttctcctactcagcctcccgcagcttcttcggagaaaaccggttctgtaatgaaatttatagtagcagaggcaccattattaggacctgcaggtttcaacaaccctcaagtaattgaagttgcttcagtagctttagctgctcaaagaacatatagaaaagatcctctcaatggttttgagaaatatactggaggatggaatatcagcaaccaacattactgggcttcagtgagctatacagctgttcctctctttgttcttgctgctgtttggtttcttgggtttggcatctgtttattagtcatctgtatgtgtcacatttgccatagaaccaattctgttggatactctaaagttgcttatgttgtctccctcatcttcctcctcatcttcactgttattgcaataatcggatgtgttctgctatactcgggtcagataaggtataataaaagcacgacagagacattagagtatgtcatgagtcaagcagatagcacgatttcgcagcttagagctatctcagattatcttgcttcagccaagcaggctgcagttcttcaggttcttttacctgcaaatgtacaaactgaaatcgatcagatcggagtgaaactggattcttctgtagctactatcactgagaaatcgactaatagctccaatcacataagacattttcttgattctgtgagagtagcgcttattgtagtttcaatcgtcatgcttgtggtgacttttcttggtctcgtttcttcgattttcgggatgcaggtcatcgtttacacccttgtgatcttgggatggattctggtgactggtacattcatcttgagtggaacattccttgtgctacacaatgcaactgcagacacatgtgtggcaatgagcgaatgggttgagagaccatcaagcaatacggctctggacgagatattgccttgtacagacaatgccacagctcaggaaaccttgatgcgtagcagagaagtgacgggtcagcttgtggagctaatcaacacagtcatcactaatgtctccaacatcaacttctctccagtctttgtcccaatgtattataaccaatctggaccgttgcttccattgctctgcaatccttttaaccatgaccttaccgatcgctcttgctcgcctggtgatctcgatttgaacaatgctactgaagcatggaccagtttcgtgtgccaagtgagccagaacgggacttgcaccacaacaggaaggcttacacctgcgctgtacagtcagatggcatcaggtgttaatatcagcacgggattgatcagagacgcgccattcctggtccagcttcaggactgttcatacgcaaaacagacctttagagacataacgaatgaccattgtcctggactacagcgttatggctattgggtctatgtgggtctggccattttagcaacggctgtgatgctctcacttatgttctggatcatttacagtagagagcgaaggcatcggaaggaagctctgcctgaattttctgaaagtaaggagattgtaagagttaacttttgatgtatgtctctgtagatcttaagcaaaatgttt

SEQ ID NO: 847 - DNA, 1965 bp, Arabidopsis thaliana
tctctggtctccctatatcagcgctttttagctgatcctctctccggcatttctctctctctcttttttttagccatggagaaatttgcgcctgtcgctgctctgttactgcttcttctctgttttccggtagctttctccggtcatgattatggtcaagctctttccaagagtcttctcttcttcgaagctcagagatctggtgttcttcctcgtaaccaaagagtcacttggcgctctcactccggtctcaccgacggcaaatcaagcggcgtgaatctggtcggaggttactacgacgccggagacaatgtgaaatttggattaccgatggctttcacggtgacgatgatggcgtggagtgtgattgagtacgggaatcaattacaagccaacggcgagcttggaaactccattgacgccattaaatggggtactgattatttcatcaaagcccatcctgagcccaacgtcctttacggcgaggttggagatggcaacaccgaccattactgttggcagagaccggaagaaatgacgacggaccggaaagcttacaggatagatccgagtaatcccgggtcggatcttgccggagaaacagcagccgccatggccgccgcatcaattgttttccgccgatctaaccctgtttactctaggctactactcactcacgcctatcagttgtttgatttcgccgacaaatacagaggaaaatacgacagcagtatcactgttgcccagaaatactaccgatccgtcagcggttacaatgacgagttattgtgggccgctgcgtggctataccaagcttcgaacaatcagttctacttggactacttgggtcgcaacggtgacgccatgggtggtaccggttggtccatgactgagtttggttgggacgttaagtacgctggtgttcaaacccttgttgccaagtttttgatgcaaggcaaagcaggacgtcacgcacctgtgttcaggaagtatcaagagaaagctgattcctttatgtgttccttgttgggtaaaagctcgaggaacattcagaagacaccaggtggtttgattttcagacaacgttggaacaatatgcagtttgtcacaagcgcttccttcttgaccacggtttactcagattacctaacttcttctcgaagcaacttgagatgtgccgcgggaaatgtcgcaccttcgcagcttctttcctttgctaaatctcaggtggattatattcttggagataacccgagagctaccagctacatggttggttatggtaacaatttccctcagagagttcaccacagaggctcttccatcgtctctgtcaaggtggaccgtacatttgtcacctgccgaggtggatatgccacttggttcagccgtaaaggcagtgacccgaaccttctcactggtgctattgtcggtggccctgatgcttacgacaatttcgctgacaggagagataactatgagcagactgagcctgctacttacaacaatgcaccactccttggtgttcttgctcgtctcagcagtggtcattccggttatagccagtttcttccagtggttcctgctcctgttgtccgaagaccaatgcctattcgtagaccgaaagtgactactccagtccgagcttctggtccagtggctatagttcagaagataactagttcatgggtctcaaagggaaggacttactacagatactcaacaactgtgattaacaaatcttctagacctctgaaaagtctcaacctttcgatcaagaatctctatggaccaatctggggactctcgagatcaggcaactcgttcggtttaccctcgtggatgcactcattgccatccggaaaatccctagagttcgtctacattcactcaacaacacctgcaaatgtcgcggtatccagctacactttggcttgatcagacaacaacaacaacatcaaatag

SEQ ID NO: 848 - DNA, 691 bp, Arabidopsis thaliana
aagaagaaagaaacagagaatcgccatggcagagaaagagaagaaaacaaaaaagaagaagaagaaagagaagcatcaatcttccgacatctctttcaagccttcttcagacgtaaaaggactcaaattcggcggccaaataatcgtcaaatcattcacaatccgacgagcaagaacattcgagcttcttaaactcctctctctcccttcttcatcatcaccgccgcttctttccacggcggcttaccttccgacaaacttcacaatccttgcacaccacgcatggcacacactaacactaggtctcggaacaagaaagtccaaagttgtggtcttcgtgttcgaaacagaggcgatgaaatcatccgttgtggcggcggaaggaggaatctggccatcggagattccattgggagatgtgaacaagaagatgatcagaaagttaaagaactgggagatggcaaggtttaagttcagaaaaggttgtatcacgttttacgtttacgccgtgagaaacgccggaaatgaagggtttgcggcggcggaggacttaaaggtaatattacaagcggtggtggcattgaaagatttcatggatcacaccgcaatgcttgtaatgccccaccagaaaagtattaattacagctcttgtcctccttttgccatggctcactgaactttgaacaattag

SEQ ID NO: 849 - DNA, 3183 bp, Arabidopsis thaliana
ggagattttgtaatggattctgctattgaaattagttcaggtagtgatagtgatgacgaagtaccaccgcagcctgtttggccacaaactcgaaccaggatggatcccacatggctaagcaggagacctttgcctacagtggatagccatgctagagctgaacatacaaatcaggctcctcccaatggtgcctcgagtgatacttctcggcctggagtctctaagcctttcacagggaatgggaacactgtaaactcgagaatttccagtggatctggtgctgattatgtgagactgtcttctgagcaagctctgaaaagaactcttccaccctcttttaattcccctccccttcctgccagaagtggcactaacaatataagtaatgctagtggaagtcgtgttggtgtggattatgagagaccattgtctcagcaagctctgaaaagaactcttccaccctcttttaatccccctccccttccttccagaagtggcacaaacaatatacgtaatgctggtgggagtcgctttggtgccgattatagtcatccagctgtgtcagctgtaggcaacaagagtacctttggtgatcattatagtggagcccatgctgagataggaattcaacgtggcgtgaatggggttaggatcctgcctccatctctgacgcatggaacatctgcttctgttttgcatcatgctggttcgagtgatccaatgcacaggtttggtggtggtgaagataggaatcctgataacgatgaaaggctggtttatcaggctgcactacaggttttgaatcaacccatgactgaaagtgatctacctcctggtactctttcagttcctcttatgaggcatcagaaaattgcgttggcatggatgtttcagaaggaaacaagtagtttcaactgtccaggagggatactagcagatgatcagggacttggtaagacggtctcgacgattgctcttatcctaaagcaaaagattgtgtcacaactgaagtccgaaagttcatgcaagcaagaaactgaggcattagtcctggatgctgatgatgagtcagacaatgcaaagcatgaaagtggtagtcatgtaaaaccagagctcaaggtttcaagcaacagtgagacctcggttctgagtgcatgtggtaatgatgagaatgacagttcagatatggagaaagccgaagatgaagaagctaattcttcaacacgagcatttcagtggaagagaccagctgctggtacattaattgtttgcccagcgagtgttgtaaggcagtgggcaagagagcttgatgagaaggtttctgaagaatccaaactttctgtgttagtctaccatggtagtaataggaccaaagatcctaatgaattagcagaatacgatgtggttgtgacaacgtacgctattgttactaatgaagctcccaacaaattcttggtggatgaggatgagaacgatgaaaaaaatactgacagatatggtcttgcctctggcttctccaacaataagaaacggaaagtcgtggtgggtgctagtaagaagagtaaaagaagaggtagaaaaagcactaacgatacttcttctgagcctgattgtggtcctctaggaaaggttgggtggttcagaatagtactagatgaagctcagacaattaagaactatagaacacaaatggcaagatcatgttgcactcttcgagccaaaaggaggtggtgcttgtctggaacaccaatacaaaatacgattgatgatttatatagctatttcaggtttcttagatatgatccatatgcggtgtacaagtcattttacagtacaatcaaggttccaatttccagaaattcttgtcaaggttacaagaagcttcaagctgttctaagggctataatgctgcgccgcaccaaaggaacattgcttgatgggaaacccataattaatctacctccaaaggtagtaaatttgagccaggtagacttttcagtggctgagcgctctttctacaagaagcttgaagctgattcacgttcacagttcaaggcctatgctgatgcgggaactttgagtcaaaactacgcaaatattcttctgttgcttttgcgactacgccaagcttgtgaccacccacaacttgttaaaagatataactcagatcctgttggaaaagtatcagaagcagcagttagaagactccctagggaggctcgaagcagactgatcaatcgcttagagtcatcatctgccatctgctatgagtgcaatgagccaccagaaaaacctgttgttacgttgtgtggccatatattttgctatgaatgtgttttagaatacataactggggatgagaacacgtgccctgtaccgagatgcaaacaacagcttgcgcgtgatgttgttttctctgaatcttctcttagaaattgcacttctgatgattcgggctgtagttcctctcatgataatggtcttgatagatcggtatttcaaaaaagagacttttgttcatcaaaaattaaagctgtcctcgatatcctgcagtcgctttcccaaccagacagtccaaactcagctcagcatggtcaaatgccatcttcctcacggccatatgatgacgatgatgttaccattgtagagccaatgcgtcttcactcatcttcacctagccagggggcagtaaagacgataatattttctcagtggactggtatgcttgacttggttgagctgcgtattcttgaaagtggtattgaattcagaagattagatggcacaatgagtctagcagcaagagacagggcggttaaagaattcagtaaaaaaccagatgtaaaggtgatgctgatgtcgctaaaagctggaaaccttgggctgaatatggtagctgcatgtcatgttattctcttggatctttggtggaatccaactaccgaagatcaggcgattgatcgtgcacatcgtattggacaaactcggccagttactgtaactcgcataactataaaagacaccgttgaggatagaattttgaagcttcaggaagagaaaaggacaatggttgcatcggcctttggtgaagaacatggtggaagctctgcgacacgtctaacagtagacgatctcaagtatctgtttatggtgtagactactcgttgtatggtctaagcgtaa

SEQ ID NO: 850 - DNA, 2000 bp, Arabidopsis thaliana
caggggtttaaggattttctccgaaagctcaaaacttgagtgaaatttctctcattttacttatctgaagttcgtctacgatggaggaagagaaggtgagggttcgtctggtgtttgaagaccgacggattctgagtaagtatcaaaagaagcaaggtttaacacggagctgggttgttctaaatcgtaaatgtcaccgaactatatcagagttttctgatcatatctttcacacatttagcctctgtgaagcgtgtcctcatggcctctctctatctatggaaggtttcgttttgccacctttcgagtccagctgtgtattgaaggataaagatatcgtttgtgttaagaagaagaaagagtctttgttggagattgttggggaagacagtgatgagaatgtttacaacgctattgaggttgaggaaaggcctcagattcgtcctggtgaaatgctgcttgctaatgaggaattccagaaggaaactggaggatatgaaagtgagtctgaggaagatgagcttgaagaggaagcagaagagtttgtgccagagaagaaggcttcgaagaaacgtaaaacttcaagcaaaaaccagagcaccaagaggaagaagtgtaagttagatactactgaagaatctcccgacgaaagagaaaacacagctgttgttagcaatgttgtgaagaagaagaagaagaagaaatcattggatgtacaaagtgctaacaatgatgaacagaataacgatagtaccaaacccatgaccaaatcaaagaggtcatcacaacaagaagagagcaaagagcataacgatctgtgccaactatctgctgaaactaaaaagacacctagcagaagtgcccgacgtaaaaaggcgaaacggcaatggctgagagagaaaacaaaactagagaaggaagagcttctacagacgcagttggttgtagcacccagccaaaaaccagtcatcactatagatcaccaagcaaccaaggaaaagcactgtgaaactcttgaaaatcaacaggcagaagaagttagtgatggtttcggggatgaagttgtacctgtggaagtgaggccaggccacatacgcttcaagcctctcgctggaacagatgaagcctctcttgatagtgaacctcttgtggaaaatgtcttgtggaatggaaacatgacgaagaagaagggacagaaatggggcacagagaagtcagggttttccaaacgatatgctcaggattttaatgaagatgctacgacacagcccgctgaagcagagacacttgctaattgtccgattgattatgaacagcttgtggcttacactggctcagtaaagaaaggagatgttattgcataccgcctcattgagttaacatcatcttggacacccgaggtttcctcttttcgggttgggaagataagctactatgatccagactccaagatggtgactttgatgcctgttcaagaatttccaatcgagaaaaagacagaagaggacgacgatttctgtatgcaacctgatacatctctttataaagaagatggatccctggagatagaattttctgctctgctcgatgttcgcagtgtcaaaactagcagctcagattctgcagaagtcgccaagtcagcactgcccgagcctgaccagtcagctaaaaagccaaagctaagcgcaaacaaagaattgcaaacccctgcaaaagaaaatggagaagtgagcccttgggaagaactaagtgaagctttaagtgcaaagaaagcagcgttgtctcaggccaacaatgggtggaacaagaaagggagttcaagtggaggctcatggtcttacaaggcactgcgaggcagtgctatgggtcctgtaatgaactatctcagatctcagaaagagatttgagaaactaggtcacatctctctagaagaaactctgctgcttttgtcttcattttggatatgaaaaactcagacaaagggtagagaaagccattt

SEQ ID NO: 851 - DNA, 1087 bp, Arabidopsis thaliana
tggtaggctgagagaaagaaagaaaaagataaagatggatcacgcagcagatgctcaccgtacggatttgatgaccattacaagattcgtgttgaatgaacaatcaaagtatccagaatctcgtggtgatttcaccattttgcttagtcacatcgttttgggttgcaaattcgtttgcagtgctgttaataaggctggtttggctaagttaattggacttgcaggggaaacaaacattcagggtgaagagcaaaagaaacttgatgtgctctctaatgatgtctttgtcaacgctttggttagcagtggtagaacttctgttcttgtctcggaggaagatgaggaagctacgtttgtggagccatccaagcgtggaaagtactgtgttgtttttgatccgcttgatggatcttcaaacattgactgtggtgtttccattggcacaatttttggaatttacacgttggaccacactgatgagccaaccactgcagatgttctgaaacctgggaatgaaatggtggctgcaggttattgtatgtacggaagctcctgcatgcttgtgttgagcactggaaccggtgtccacggatttacactggacccatctctaggagagttcattctaactcacccggacattaagattccaaataagggaaacatttattcggtgaatgaaggcaatgcgcagaactgggatggtccaactacaaagtatgtagagaaatgcaagtttcctaaagatggttctcctgcaaagtctctgagatacgtaggaagtatggtagctgatgttcatcgtacactactttatggaggaatcttcttgtacccggctgacaagaaaagccccaatggaaaattgcgtgtcttgtatgaagttttcccgatgtcgtttttgatggagcaagccggaggtcaggcctttacgggaaagaaaagggcgctagaccttgtcccggagaagatccatgagcgttctccgatatttcttggtagctacgatgatgtagaagagattaaagctctctatgctgaggaggaaaagaagaactaagcttctcattcttcttttattctctaa

SEQ ID NO: 852 - DNA, 5496 bp, Arabidopsis thaliana
tctcggaggtatcttattccagggatcaaggattagacttaatgcgattaagcaaatgggtttttcacgatgactctccttgttgttggggagattcaataaatggactcacaagatcacaaagcacctggctttgttgacatagtcaaatcttggatccctagaaagagtgagtcctcaaatatgtcgagggatttttggatgcctgaccaaagctgtcctgtgtgttatgagtgtgatgctcagttcactgtgtttaatcgaagacatcattgccgcctttgtggtcgagttttttgtgccaaatgcgctgcaaattccattccatctccatcagatgaaacaaaggatagtcatgaggaaccagaaaggattagggtgtgtaattactgctacaaacagtgggaacaggggatagttccccctgataatggggcttctattattagccttcattttagttcatcgccttctgctagaagcgtcgcaagtactacctctaatagtagcaactgcaccattgattcaactgctggaccttcccctagacccaaaatgaatccccgagctagccgtcgtgtctcgtcaaacatggattctgaaaagtctgagcagcagaatgcaaaatcgcgtaggagctcagatcattatgggcatgtgttagattcttctgataatcaagttgaattctttgtcaacagtagtggcaggagtgatggtgaagctgatgacgatgacgattatcaatctgattttgcacaatcttacgctcaaggaaatgactactatggtgccatcaacctcgatgaagtagaccatatctatgggtcacatgaagctcatgacgttggtgtaaaaatagaaccaaacataagtggctttccccctgatcaagatcttgactcactgaatacagagacgatagataaaaccagacaacaagaaaatggatggaacgatgtaaaggagggaagccctccttgtgaagagtcctttgagcccgaagttgttgattttgagagtgatgggctcttatggctaccaccagagccagagaacgaagaagatgaaagagaagcagtgctatctgatgatgacggtgatgaaggtgatagaggtgattgggggtaccttcgcccatcaaatagctttaacgagaaggatttccactctaaggacaagtccagtggtgctatgaaaaatgttgttgaagggcactttagggctttggtagcacaacttttggaggttgataatctacctatggtcaacgaaggtgatgaagagggctggcttgatataattacatcattatcttgggaggctgcaacgcttctcaagccagatacaagtaaaagtggaggaatggatccaggaggatacgtgaaggttaaatgcatcccttgtggacgtcgcagtgagagtatggtcgtgaaaggagttgtttgtaagaaaaatgtggctcatcggcgaatgacttcaaagatcgagaagccgcgtctgctaatccttggaggagctctggagtatcagcgcatctctaaccagctgtctagttttgacactttgttgcaacaggaaatggaccatttgaagatggctgttgccaaaattgattctcacaatcctgacattctcttggtggagaaatctgtctcgcggtttgcgcaggaatatcttctcgcgaaggacatatctctcgtgttaaatattaaaaggtcccttctagagcgcatatcccgctgtactggtgcgcagattgtcccttcgatcgaccagctcacatcaccaaagctaggttattgtgacctgttccatgtggaaaagtttgtggagacacatgttagtccttgtcaagttgcgaagaaaatggccaagactttaatgttttttgatggctgcccgaaacctttgggttgtacaatattgctcaagggggcacatgaagatgagctaaagaaggtgaaacatgtgattcagtatggagtttttgcagcatatcacttggctcttgagacatccttcctagcagatgaaggtgcttccattcacgaacttcctctgcagaccccaattactgtggcgttacctgataaaccatcaatggttaacagatcaatatccacaatacctggttttactgtgtcaagtgctgaaaagtctccaactactgagttaaggggtgagccacataaagccaatggcgaccttactggtaatttcacttctagtaagactcatttccaagggaaattggatggaaacgacaggattgacccatctgaaagactgcttcacaacttggatactgtttactgtaagcctccagaaactattacctctaaggacgatgggttagttcctactctagaatccaggcagctatcatttcacgtggaagaaccttctgttcaaaaagatcagtggtctgttttatccggtgccacagaacaagtaacagatggtggttacacgaatgactccgcagtaataggaaatcaaaattttaatagacaggaacaaatggaatcttcaaaaggagactttcatccgtcagcttctgaccatcaaagtatattggtttccttatcaacaagatgcgtatggaaaggatctgtgtgtgagcgggctcatctactccgtatcaaatactatgggagctttgacaagcctttaggacggtttttaagggataatctctttgatcaggatcagtgctgcccgtcatgtacgatgccagcggaagcacacattcattgttatactcataggcaaggtagtctgacaatatctgttaagaaactgcctgaattgctacctgggcaacgtgaagggaagatttggatgtggcatcggtgcctgaaatgtcctcggatcaatggctttcctccagccacacgcagaattgtaatgtcagatgctgcgtggggcctgtcttttggcaaatttttggagctgagcttttctaaccatgcagcggctagtcgtgtggccaactgtggtcattcccttcacagagactgtctccggttctacggttttgggagaatggttgcttgcttccgctatgcttcaatcaatatttacgcagtgactctgccaccagcaaagctttattttaactatgagaaccaggaatggctccaaaaggaatcaaaagaggtgattaaaaaagcggaagtcctttttaatgaggttcaggaggctcttagtcaaatttcagcgaaaactatgggcgcaggttccaagggcagcactcccaacaagatcaagctttctcttgaagaacttgcaggacttcttgagcaacgtaaaaaggaatataaggattcattgcagcaaatgttaaatgtggttaaggatggacaacctactattgatatccttctgataaataaacttcgaaggctgataattttcgattcatatgcttgggatgaatgcctagcaggggcggccaatatggtaagaaataactatttggaagctccgaagaattcagccccaaaagttatgggtcgtaacgtctccttagagaagctcagtgatgaaaaagtaaagtcgataccgacccatgttgcaatttgtaatgactctcttctccaggatgcagactacgaaacgtgtcttaaccaaggtaaatcatttgctgatactagtggcaaatttgctattcctgaagatgtaggctcagacagacccccagattgtaggatggagttcgaccctagtgaaggtggtaaagataattttgtagagtcttcgcaggtggttaaaccagcacacaccgagagccagtttcaagcaacagacttatctgatactcttgatgcagcatggataggtgaacaaactacttcagagaatggtattttccgtccgcctagcagagctgcttcaacaaatggaactcagatccctgatttaaggctgttgggttcagaaagtgagctgaactttaaaggaggccctaccaatgatgaacatacaacacaagttcagttgccttctcctagtttctactattcactcaacaagaattattcgcttaattctcgcaagcatatcatggctgaagaccggcctgtttatgtttcttcatatagagagcttgaatggcgaagtggtgcaaggctgctgcttcctctgggatgtaatgacttagtactgccagtttatgatgacgaacctactagtatcatagcttatgcccttacatcatcagaatataaagctcagatgtctggatcagataagtcaagagatcgcttggatagtggaggttccttttcactttttgattctgttaatcttctctcattgaactctttgagtgatttgtcggtcgacatgagtagaagtcttagctctgctgatgaacaagtctcgcagctgctacattcatcactgtatttgaaagatctgcatgcgaggatttcgtttacagatgaaggtcctcctgggaaagtgaagtactctgtgacgtgttattatgctaaggagtttgaagccctgaggatgatttgctgtccttcagaaacagatttcattagatctcttggtcgttgtagaaaatggggagcccagggtggaaagagcaacgtcttctttgcaaaaagtttggatgaccgttttatcatcaagcaagttacaaagacagagcttgagtccttcatcaaatttgggccagcttacttcaaatacctgactgagtccatcagtactaaaagccctacaagccttgcaaagatcttgggaatctatcaggtttcatccaaacaccttaaaggaggaaaagagttcaaaatggacgtcttggtgatggagaatcttctgttcaagcgaaacttcactaggctttatgacctaaaaggctccactcgggctcgttacaatcccgatacaagtggtagcaatacagttttgctggatcagaatcttgtcgaagcaatgccaacatctccaatatttgttgggagcaaggcaaaacggcttcttgaaagagcagtctggaatgatacatcatttcttgcttcgattcacgtaatggattactccttactagtcggggtagatgaggaaagaaacgagctggttctaggaattatcgatttcatgaggcaatacacttgggacaaacatctggagacttgggtcaagacttcagggctccttggaggacccaagaactcaactcccacagtgatatcgccgcagcaatacaagaaaagattcaggaaagcgatgacggcttattttctgatggttcctgaccagtggtcgcctgccgcggttgtgccaagcaacagttcttcagcagaggtgaaggaggaagaagagaaagacaatcctcaagctgttggtaacaagtcctgaagtattttcagcaaacatacacaatattcagttagcaaatatagtttttattttttttggttggaatggtcttttgggtaatttgtgtttatgtattacccttggccttaagtgtggcat

SEQ ID NO: 853 - DNA, 6559 bp, Arabidopsis thaliana
tctgggtctacttttgatttgagaattttttaagtgaagtgaagatatgacaagtgctcttggatggagatttccttccactaatggaaatggccttgccccaagtgacacggagagaaatggggatatgaagatgcatgattcagagcccccaactccacattcaaccacaaagatgagtttgagagaccggacaaccagcatggaagatccagatgggacattagcaagtgttgcccaatgcattgagcagctgcgccaaggttcatcatctgcacaagaaagagaatattgtctgaagcagttactggaccttatagaaatgcgtgagaatgcattcagtgctgtcggatcacactcccaagctgtgccagtacttgtctctcttctccgatcgggatcagttggagtgaagatacaagctgcaaccgtcttgggttcactctgcaaggagaacgaacttagagttaaggtgttacttgggggatgcattcctccattgcttggtcttctcaagtccagttcagtcgaagggcagatcgctgcagcaaagacaatctatgctgtttctgaaggtggggttaaagaccatgttggatcaaaaatattttccactgagggagttgtaccggttctgtgggaccaattgcgcagtggaaataaaaaaggagaggttgatggtttgttaactggtgcacttaagaacctttctagtaccacagagggattttggtctgagacaattcgagctgggggagtggatgtacttgtgaagctgctcacaagcgggcagtcaagtacactatctaatgtctgcttccttcttgcgtgtatgatgatggaagacgcctctgtttgttccagtgtattgactgcagacattacaaaacagcttctcaaattattaggatcgggtaatgaagccccagtgagggcagaggctgctgctgctctcaagtcgctttctgctcaatctaaggaagcaaagcgggaaatcgctaattctaatggtattcctgttttaataaatgcaacaatagctccatctaaagaattcatgcaaggtgaatatgcgcaagcattacaagaaaatgcaatgtgtgcccttgctaatatttccggtggtttgtcatatgtcatatcaagccttggtcagagccttgaatcttgctcttcgcctgctcagactgccgacacccttggggctttagcttcagcattgatgatatatgatggcaaggcagaaactacaagagcatcagatccattggtcgttgaacagactctgctgaagcagtttaagcctcgtctaccattcttggtgcaagaacgtacaattgaagcacttgcaagtttgtatgggaattccatactctctgtcaaactttccaactcggatgcaaaacgtttgcttgttggtctaataacgatggcggtgaatgaggttcaagatgagcttgtaaaggctcttctgatgctgtgtaaccatgaaggtagcctgtggcaagcactacagggccgtgaagggatccaattgctaatatctcttttgggtctttcatccgaacagcagcaagaatgtgctgttgcacttctttgccttttgtctaacgaaaatgatgaaagcaagtgggccatcactgctgctggaggtatacctccacttgttcaaattctagagactgggtcggccaaagccagggaagactctgcaactatccttaggaacttgtgcaatcatagcgaagatatacgtgcttgtgttgaaagtgcggatgctgtccctgctctcttatggctactaaagaatggtagtccaaatggtaaagaaattgccgccaagacattgaatcatttgattcataaatcagatactgcaactatcagtcagcttactgctttgctgaccagtgatctacctgagtctaaaatttacgttttggatgcattgaagagtatgctttctgtggtcccattcaatgacatgctacgtgaaggcagtgcttccaatgatgctattgagacaatgatcaagttgatgagctctggtaaagaagaaactcaagcaaattcagcatcagctcttgcagctatcttccagagcagaaaggatttgcgtgagagtgctctagccctcaaaactctcttgtcggccataaaactgttaaatgtggattcggagaggatccttgttgagtcttgccgctgcctggctgcaattttactttcaattaaggagaatcgcgatgtggccatttctgccagagaagcattgcctaccatagtatctctagccaactcttctgttctagaagttgctgagcaaggaatgtgcgctttggctaatcttatattggacagtgaagtgtcagagaaggtcattgtcgaagatatcatcttgtccgccactagaatcttacgtgaaggtacagtgtctgggaagacacttgctgctgcggcaattgcccgcctccttagtcgtcgccgaattgattctgcattgacagattctgtgaaccgagctggaacagtgcttaccttagtgtctcttctagaatctgccgatggaagatctgatgcaatatcagaggccctagatgcgcttgctatattctcaaggtcaggagctaatggaaatgtaaaaccagcttgggctgttttggctgaatctcccaacagtatggccccaatagtctcatctatagtgagtgttgctaatccttcactacaggacaaagctattgaagttttgtcaagactttgccgagatcagcctattgttttgggaaacatggtcaacaatgccagagattgcgtgtcatctatagctaaaagggtgataaataccagggacccgaaaataaaaattggtggagctgctattattatctgtgctgccaaagttgacgaccagaagatgatagaaaatctgaatgagacacaattgtgtgccaaattcgttcaagcacttgtggggatcctagattctgtgcaagatcaggaaaaggatgagaaagataaaatctgcatatgcattcatcccaaagaaaaggaagaagatgaagaagaagaggcaacagaaaatagggagggttccacgggggcaacagttatttctggagacaatttagccatctggttgctctcggttctttcttgtcatgatgaaaagagcagagcagtaatattggagtcagaaggcattgagttgattactgacagaataggcaaccgttttctccaggctgataatggagaagatgccaacatttgggtttgtgctttattgctggccatacttttccaagacagagaaatcactcgcgcacatgcaacaatgaaggctgttccagtgctctcaaatcttgtgaagtcagaggaatacgcagacagatattttgcagcacaagctctagctagtcttgtctgtaacggtagtcgcggaactcttctatctgttgcaaactccggtgctgcggctgggtttatatcattgcttggttgttctgatgatgacataaaagaacttctgcagctgtcgcaggagttcactttagtgcggtacccagaccaggttgcccttgaaaggcttttccgagttgaagatattagagttggggctacttctcgaaaggcgattcccttactagttgaacttcttaaaccaattccagaccgccccggtgctcctctactttcacttaatcttctaactcagcttgctggggactgtccacaaaatatgattgtcatggtagagtcaggtgctcttgagggtctctcgaaatatctttcccttggacctcaggacgagcaagaggaagctgcaacaggtcttttaggcatcttatttagcagtgctgaaattcgaaggcatgagtcagcatttggcgcggtcagccaacttgtagctgttttgcgtctaggtggaaggggggcaaggtacagtgccgccaaggcattggatagtctctttactgctgaccatataagaaatgcagagtcttctagacaagctgttcagccattggtagagattctcaacactggttcagagagggagcagcatgctgctattgctgcacttgttaggttgttgagtgataatccatcacgggctctggcagttgcagatgtggagatgaatgcggtggatgttctctgcaggatcctttcttcaaactatacgatggaactgaagggagatgctgcagagctgtgttatgttctgtttgcaaatacaaggattagatctacagttgctgcagcgcgttgtgttgagccacttgtctctcttcttgtgactgagttcagccctgctcagcattcagttgtgcgtgcactggacaagcttgtcgacgatgaacaactggctgaactagttgcagctcatggcgctgtggtacctcttgttggccttctctatggtaaaaactatgtgcttcatgaggctatatccagggctctagtaaagttgggtaaggacaggcctgcttgtaaactggaaatggtgaaagctggagttatcgactgcgtacttgatattctccacgaagctccagattttctatgtgctgcgttttcagaactgcttcgaatcctcacaaataatgctactattgccaagggacaatctgctgcgaaagtggtggagccacttttccatttgctgacgaggttggagtttggagctgatggacagcacagtgctctgcaagttctggtaaatatcttagaacatccacaatgccgcgctgattatacacttacaccgcaccaagtaattgagcctttaattccgctactggaatctccatccccagcagtccagcagttggcagctgagcttctatctcatcttctctacgaggagcatctgcagaaagatccattaacgcaacttgcgattggtcctctaatccatgtgctgggatccggcatacacctattacagcagagagctgtgaaagctctcgtcagcattgctctaacatggccaaatgaaatagctaaagaaggtggtgtgagtgagctgtcaaaggtgatactgcaagctgatccatcgctctccaatgtgttatgggagtctgcagcatcaattttggttatcatcttgcaatttagctccgaattttacctggaagttcctgttgctgttcttgtaagactgcttcgttctgcatctgaaaacaccgtggttggtgcacttaacgctcttctagtgttggaaagcgatgatggaaccagtgcagagtccatggctgaaagtggtgccatagaagctctgcttgatcttttaaggtctcatcagtgtgaggacacagcagcgagactgctcgaggtactgctcaacaacgtgaagattagagattcaaaagccaccaagactgcaatcttgccattgtctcagtacctcttggatccacaaactcaagctcagcaggcgcggttactagcaactttggcccttggtgatcttttccagaatgaagctcttgctagaagcaccgatgcagcttctgcttgccgtgctttagtcaatgtccttgaagaacaacccacagaagaaatgaaagtagttgctatatgtgctctgcaaaatctcgtcatgtatagccgatctaacaaaagagcagttgccgaggcaggtggtgtgcaggtcgtcttggatctgatcagttccagtgatcctgaaacgtctgttcaggctgcaatgttcgtaaaactactcttctctaatcacaccgttcaagagtacgcatctagcgaaaccgtcagagcaataactgctgccattgagaaagacttatgggccactggaaccgtgaatgatgaatacctaaaagccttaaactctttgtttaacaacttcccgcgtctaagagctacagagcctgcaacactaagtataccacatctagttacatccctcaagacaggatcagaagcaacacaagaagctgccttggatgcattgtttcttctcagacaagcttggtcagcctgtcctgccgaagtttccagggcccaatcagttgctgctgcagacgccatccccctacttcagtacctaatccaatcaggtccaccacggttccaggagaaagctgaattcctcttgcagtgtttgccaggtactctggtagtcactatcaaacgtggtaacaacatgaagcaatccgttggtaacccgagtgtgttctgcaagataacactcggcaacaatcctcctagacagaccaaggtgatatcgacaggtcctaatccagagtgggacgagagcttctcatggtcatttgagagccctcccaaaggtcaaaaactccacatttcatgcaagaacaaaagcaaaatgggaaagagttcctttgggaaagtaacgatccaaatcgatagggtggtgatgctgggagcagtcgcaggtgaatatagtttgttaccagaaagcaaaagtggtcccagaaaccttgagatagaattccagtggtctaacaagtaaaccaccacttcattttttgtttttgtttgagaggtttcttaaatcgaaacttctgcttca

SEQ ID NO: 854 - DNA, 508 bp, Arabidopsis thaliana
cgaatcgtaattgttgaagagagcaaatatggcttgggatttgtttttatggatagtctccttcttcgttagcttggctctcgtcgcttccgtcttctaccaggttatctgcttaacggatttagaagctgattacttgaacccttttgaaacaagtacccgtatcaaccgattagtaatacctgagtttatcctccaagggtcactctgccttctcttcctcctcacatggcattgggtcttctttctggtcgccgtccctgtaacagtctatcacgcaatgttatacaaagagcgacgttatctcatcgatgtcactgaagtgttccgtggtatcagctttgaaaagaagctccggtataccaagctcgggttctacgtctttctcttcatcatggttgtctttaggctcactctctctgcggtctatagcttcacggaagatgatgatctacttcatttgttttgatttatgcgcttgcgctctgcgttatcaaccactctctaa

SEQ ID NO: 855 - DNA, 501 bp, Arabidopsis thaliana
ttgagaatgaactcagtgtgtatctccagctgcatcaacgatgcacacgaccctcgcgtgccggttcgtcctgtacgtgcctcctacgtgaatctctataagtggccggagtccgacgccgagttcgtcaggtccgtacgtcgtggaggcggcctaccggcggcccgtgtagttgatagcatatcttgtcgacagatgtatctccgtagctacactttctctcgggaagacgacgagagcaaatcggagaaggtgtcgtctgggacgcagacgtcgtgtctagggagagttaagggaacagcgtcgtctcgacgtaagagtaaggaggaaaatggcatcatcatcgttgagagtacaaagccgcgtcgtcgtggtgagaagaggagagttagtaggaagaacaaacaagaacaagcttgttctgttattttaaggatttttcgaaggttattatcttgtgctgctaccgttgatgttgttgatccaaactaaatgacttaa

SEQ ID NO: 856 - DNA, 452 bp, Arabidopsis thaliana
cacagtaaccatgtccgtctctctgttcactgccttcaccgttctctcactctgtttacacacttcaacatctgagtttcagctgtccaccatatcagctgcaccttcgttcttgcctgaagctccatcgagtttctcagcttctaccccggccatgtctccagatacctctcccctgttccctactccaggttcaagcgaaatgtctccttccccgtcggaatcgtctatcatgccgacaatcccctcaagccttagtccaccaaacccagatgctgtcactcctgatcctctgctcgaagtttctccagttggatctcctcttccagcttcttcctctgtttgtttggtctcatcacaactctcatctctgcttcttgtcctactcatgttgctactagctttctgcagtttcttctagtaatcatatagaaacagcgagtaagcagcac

SEQ ID NO: 857 - DNA, 702 bp, Arabidopsis thaliana
ctcaaacccaagaacctcatcgccgattatttcttcatccttactctatcccgcgccgattaatctctctcagtaccgtccgagatgagaaagctcaagtatcacgagaagaagcttataaagaaagtaaatttcttagaatggaaaagagaaggtaaccatcgggaaaacgagattacgtatcgataccacatgggctctcgtgatgattacaaaaagtattcaggattgtgtaggatggtgcagaaactgacgaatataatgaaacaaatggatccagcagatccttttcgtattcagatgactgatatgcttttggagaagctatataacatgggtgttataccgactaggaaaagcttgactctaactgagcggttatcagtttcatccttctgtaggcgtaggctatctactgtgctggttcacctgaagtttgcagagcaccacaaagaagctgtgacatacatagagcaaggacacgttcgtgtaggaccagaaacaattactgatccagctttcttagtaactcggaacatggaagatttcatcacttgggttgattcatccaagattaaacgaaaggttcttgagtacaatgacacattggatgattatgacatgcttgcttagctttgaggaagttaaaaaagactgatgttttgtaaaagccaaaaaaggttcactgctactactattgca

SEQ ID NO: 858 - DNA, 898 bp, Arabidopsis thaliana
ttcagacaaaaacagagagaaactttttgtgtttatgtgttttaagatctgattgataaaaaagatgcaagttatttctccttcgtctccggcgccgagattcgccggaaaagagagattttcagaagtttacggcgaactaaacgacgattttggctctaaactgaagattagttctaaagaggaagaaaacagagatgatgattcatggtggaatcagaacggaactgataaagatgatgaaggaagagaagaagatttctcattcgcaagtgtaaacgcagataattcaccgataaccgcagatgaagcattcgaagacggtcagatccgaccggtttatcctctgtttaaccggaatattttcttcgatgatccagaggaaaaaactttacgttcacctctcaagaaactcttcgttgaatccacaaccacagaagaagaagaagaagagtcagatacggtgggtccatattgttcatggacaaatcgtacggtggagcaagcatcaccagagacttgtcggaaaagtaactcaacagggttctcaaagctatggagatttagagatcttgttttgagaagtaacagtgatggaaaagatgcgtttgtgtttttaagcaacggctcttcatctacatcgtcgacgtcgtctacggcggcgagattgagtggtgtggtgaagtcgtcggagaaagggaaagagaaaacgaagacggataagaagaaggataagatgagaacgaaatcggcacatgagaaattgtatatgagaaacagagcaatgagagaagaagggaaacgaagatcgtatcttccgtataaacatgttgggttcttcactaatgttaatggtttaaccagaaatgttcatccctattgattaaaccgatcttag

SEQ ID NO: 859 - DNA, 4885 bp, Arabidopsis thaliana
aacagcttcggtttaagagttctctgtttcactccccatggctcagaagccggaggaacagttgaaagagctgggatcgaagcttgacctagctcctgtttctaaagattcattgctcaaactcttaaaggaagctgctgtttgtctttctgagttggagcagtctccaccacctgcagtgctcaagtccattcagccttttcttgatgcagttattaaacctgaaattctcaaccatcaagacaaggatgtcaagcttcttgttgcaagctgcgtttctgagataactcgtattacagcacctgaagcgccttacagtgataatattatgaaggatatttttcaactaattgtgagcgcttttgctgggttgaatgatgtcagtggtccatcatttggaaggagggttctcattttagaaacggttgcaaagtacaggtcatgtgtagtgatgttggatcttgaatgtgatgatctggtgaaagaagtgtttactacatttcttgatgttgctagagatgaccatccggagattgttttctcatcaatgcaaaatataatgattgttcttttagaagaaagcgaagatgtgcaagagcaccttttactaattttactctctaaattgggccgcaatagaagtgacgttagagatgctgcaagaagacttgctatgaaagtcatagagcattgtgcgcccaaagttgaatctgacataaagcagttccttatctcttcaatgtctggagatagccgattttccagcagtcaaattgactaccatgaggttatctatgatttgtaccgctgtgctcctcaggccctatctggagttgcaccatatctcactggagagcttttggcggataaactggaaactcgtttgaaagtggttggattggttggagagttgttttccttgcctggacgtgtcatctctgaagagttcgattcaatttttttggagtttctgaaaaggctgaccgatagggtagttgaagttaggatggccatccttgaccatattaaggactgtttgctctcagatcctttgagagctgaggcttctcaaattatatctgctctctgtgaccggctcttggattatgatgagaatatccgcaaacaagttgttgctgttatttgtgatgtgtctgtgagtgcattgacgtcgattccagttgacactatgaagttagttgctgaacggcttcgtgacaaagctatactcgtaaaaacatacacaatggaaaggttgactgagttgttccgggtatattgcttacggtgtgctgatgggaaggtagacactggcgattttaattggattcctggaaaaatcttgagatgtctttatgacaaagatttcaggtcagatacaattgagtatattctatgcagttcactgtttcctagtgatttctcagtaagagataaagttaagcattggatacaaatcttttccgggtttgacaaagtggagaccaaagcttttgagaagatactggagcaaagacaaaggatacaacaagaaatgcaaagatatttgtcaatcaagcagacacaacagactgctgatgctcctgagattcagaaaaagatcctatttggattcagagttatgtcacgtgcattttctgaccccccaaagactgagcaaaactttttaattcttgatcaactgaaagatgctaatatctggaagattttgactaatctgcttgatcccaacactagcataacgcaagcatccaggattcgggatgatatgcttaaaatactctctgagaagcattctctctatgattttctcagcactctctccataaagtgttcttatctgctattcagtaaggagtatgtgaaagagatattagcggaagtatctgttagaaagtcttctaaaaatacattggggatccaaccttgcatggacttcttagggctcctggcatgtttctgtccatcattgtttgatggcgctgaagaagaactgataagtttccttaaagatgacgatgaaatgatgaaggagggtactctaaaaattctggcaaaagcaggtggaactattcgggagaatctcattgttttagcaagttctgtggaccttttactggagaggatttgtgtagaaggaaaccgcaagcaggctaagtatgctgtgcatgcgctagcatcaataacaaaggatgatggcctgaagtcgctctctgttctatacaagagacttgtggacatgctggaggacaagagatatcagccggctgttcttcagtgtcttggatgcatagcacagattgcgatgccagtctatgagactagagaaagcgaagtagttgagtttattagaagcaaaatcctaaagctcaaaagtgaaactgtggatgacaaaaaattgtcatgggatgacaaaagtgaaatttgtcaactgaagatatatgggatcaagacgttggttaagagctatttaccttttaaggatgctcaacttcgtgcgggtgttgatgatcttcttggaatactaaaaaacattctttcctttggcgaagtatccgaagatctagaatcaagttctgttgacaaggcccatttgagacttgctgctgcaaaggctgtcctccgcctttctagacattgggatgataagatacctattgagatcttccatttaactttaaaaacccctgagataccatttcctacagctaagaaaatattccttgggaaagttcaccagtatgtaaaggatcgggttttggagatgaagtatgcctgttcattcctatttgatatcactggatcaaatgttctcgaatcagaggaggataaacacaacctagctgatatcatacagcattcttatcaaacaaaagtgcggaaaatttcggctcagactgatgcaaattcagttactctctaccctcatcatatcctcccttatctggttcatgcacttgcgcatcattcttgtcctgatgtcgagaaatgcaaagacgtgaaggaatatgaaatgatatatcgccaattatacttgatcatttctatgttgctccataaagaggaagacgggaagactgaagatattgataaggaacgtgagtacgttcccaccattattcttatcttccatagtataaaacagtcagaagatgtcactgatgcaacaaagtcaaagaactcacatgcgatctgtgagcttgggctgtcaataatcaatcacttaactcagaaagagcctgatctacaaggggaaatcacacctgtatcgctgcctccgacgctgtacaaaccttctgaaaaagttgaaggagacaagtctcaggtaggtgaagaaaaattgtggctagctgatgagactgtcctgttacacttcagggctctcaagttggagagtcatgctgatgcatctgtgatcccccaaacttcagaaaatgaggttatgattgatggggaaagtgatggaaatgaaattcctctgggtaaaatagtagagcgtttgagagctcagggaaccaagactagaaagggcaaaaagaataaatctgtaccagctgaagatgagaatggtaaaaatgatgtcgatgttttgaagatggtgagggagataaatctagatcacttacaaatgctggataaattcgaatccagtaatggacacaaacattcccctagtgagagagcagagatatgtcaaagagatcagaagggtaacaaaaggaatgttggtgatgcaacatcagtagtttcagtccctaagcgccggagatcatcttctggccatagtccttacaagttctcaaacagtggtcctaaagttcaactgaaagcttctgaagatgagttgcatctagagagtgacatggacaaaaatgtctctttggactcgcacgatgaaaattctgaccaagagaaaatgttagaaagcatctctccccggaagagaaagaaaagcttatcatcaaaattaaagattacagaatctgattgggctctcaccgatgtggagaggcagagtaggtcagcaggaggtggtgatagcaaattaaagtctgcctctggatcaatgaaaaagcgaaaaaacgtgtcaggactggcgaagtgctctacaaaggaaaataaattggtaaatgatgaactgatcggttgccgaatagaagtttggtggcctatggataaacggttttatgaagggacagtgaaatcttatgattccacaaaacagagacatgtgatactttatgaggatggagatgttgaagtacttaacctaaagaaagaacagtgggagctcatagacactggtggaaagaccgcaaagaagtccagaacatcaaagggaaattcgaagaagaaaagatcttctggaagtaagcctaagaatccggatggcgtacagagggatgaagacccagttactactacgccaaaaggaaaaagaactccaaagaaaaacttaaaacagttacacccaaaagatacaccaaaaagtctttctttagaacatgagaaagtagagagcagaaacaagaaaagacgatcttctgctttgccaatagagacagaatatagtggggaggctggcgaagaaaaatcagagtctgaaggaaagtcgttgaaagaaggtgaggatgatgaggaagttgtaaacaaggaagaagatttacaggaggcaaaaacagagtcgagtggggacgctgaggggaaagaagctgaacatgacgactcagatactgaagggaaacaagaaaacaatgaaatggagagagaagctgaagagaatgctgagacttctgacaatgagactcttggagcttggaagagtaaagtgggtaagtcaatctcgaggacagcaatataggtttgccgtatgccgtaatgtaga

SEQ ID NO: 860 - DNA, 1638 bp, Arabidopsis thaliana
ttaaaaatggagagtcaaaagcaagaagataatgaatacattttccgcagtttgtatccatctgtgcccattcctgacaaacttacactgcctgaatttgtgctccaaggagttgaagaatacacagagaatgtagcgtttgtagaagcggtgaccggaaaagctgtgacgtacggtgatgtagtgagggacacaaagaggctagccaaagcgttgacatctctcggactaaggaaaggtcaagtgatggttgtggtcctaccaaacgtcgccgagtatgggattattgcccttggtattatgtctgccggtggagtcttctccggtgcaaatccgacggctcttgtttccgagatcaagaagcaagttgaagcttccggtgctagaggaatcatcactgatgctactaactatgaaaaggtgaaatcactaggtttaccggtgatagtgttaggtgaagagaagatagaaggagcagtaaactggaaagatcttctagaagcaggagacaaatgcggagataccgacaatgaagagattcttcagacagatctttgtgcacttcctttttcttcaggaacaacaggattacaaaaaggagtaatgctcacacatcgcaatctcatagccaatctttgctctactctcttcggtgtcaggtctgaaatgatcggtcagatcgtgacgcttggtttgatcccattctttcatatttacggtatcgttggcatatgttgtgctacaatgaagaataaaggcaaagttgttgctatgagtcggtacgatctaaggattttcttgaatgctttgattgctcatgaggtttcgtttgcgcctatagttccgccgattatattgaatcttgttaagaatccgatagttgatgagtttgatctttcgaagcttaaacttcagtctgtcatgactgctgctgctcctttagctcctgagcttcttactgccttcgaagccaagtttcctaatgtccaagtccaagaggcttatggattaacggagcatagttgcattacgttaactcacggagatccagagaaaggacaaggaatcgcgaaacgaaactcggttggtttcatacttccgaatctcgaggtaaagttcatagatcctgacaccggtagatcactcccgaagaacacttctggtgagctatgtgtgaggagccaatgtgtaatgcaaggttacttcatgaacaaggaagagactgacaagacaattgatgaacaaggttggcttcacacaggagacataggttacatcgatgatgatggagacatcttcatcgttgatcgtatcaaagaacttattaaatacaaaggttttcaggttgctccggccgagcttgaagctattctactcactcatccatccgttgaagacgttgccgtcgtgccgttaccggacgaggaagccggggagattccggcggcttgcgtggtgataaatccgaaagcgacagaaaaggaagaagacattctcaactttgttgcagcaaatgtggctcattacaagaaggttagagccgtccattttgtggattcaatccctaaatctctctctggtaaaatcatgaggaggcttcttagagacaagatcctcagcatcaacaagaagtagtag

SEQ ID NO: 861 - DNA, 771 bp, Arabidopsis thaliana
tcctcttgcggagagatgcaatcgattcgtggcagtacacggttgcttcagaggcatcgtttctccatctccaacactcttcgtttcacttcttcttcttcttgtggaagctggtctgaaaatgaatccagaaaactagggtttgattcttgcccttctagcagagctgcgacatatctcattagctcgttgaaaaatgcaggcttttcctcttcagctatacctaaacaaaactttacgtatgcgtcgaggtgtttttccaccactggagattcttctgttcaaggatctcctgagtcagattgtgttgtgcctcagagaatcaagtttaagcggcttgataaaaccgctaagcatataatgcagattgtagacaaggaagcggttgaggaagtgagatctcttagagagattcctgagataaagcccggttacattgtgcagctaaaagtggaagtgcctgagaacaagagacgtgtatcaatcgtgaaaggcgtcgtcatagcaaggcgtaatgctggtctgaactcaacatttagaattagaaggcttgttgctggagtgggcgttgaatccatgttccccttgtattccccaaacctgagggagattaaggtggtggacaagaagaaagtaagaagagccaagctatattacctcagggacaaggtgaatgctcttaagaagcattaacaacctcagtaaaaaaaacaatctactcgtgtcttaaacaattttccaatgttttagttgcactctctcaaaaggaga

SEQ ID NO: 862 - DNA, 1623 bp, Arabidopsis thaliana; identical to SEQ ID NO: 19

SEQ ID NO: 863 - DNA, 1140 bp, Arabidopsis thaliana
tttcaataagaaatctgcgtccaccgtaaaccctagatttagatgggataaggtgttctttcagataaaaggtgagaactttccgaatttaacttagttgaactgagatgggttcgtcacaaggctccacactctcggctgatgtgatgagccttgtggatacattgcctgtgcttgcaaaaacccttatcgctggaggagctgctggggcaattgctaagactgctgttgcacctttggaaaggatcaaaattctattgcagactagaacaaacgactttaagacccttggtgtgtcccagtcattaaagaaggtgttacaatttgatggtcctctcggattctataaaggaaatggggcgagtgttattcggattattccatatgccgcccttcattacatgacgtatgaagtttatcgtgactggattttggaaaaaaatcttcccttaggttctggtccaattgttgatcttgtggctggttcagctgcaggtggaacagcagttttgtgcacatatccccttgatttagctcgtactaagctagcttaccaggtttctgacacaagacagagtctccgaggtggtgcgaatggattttaccgtcaacctacttattcaggcataaaagaggtgcttgcaatggcttataaagaagggggaccacgcgggctatatcgtggcatagggccaacgctgatcgggatccttccttacgcggggcttaagttctacatatatgaggaattgaaaaggcatgttcctgaagagcatcaaaactctgttcgaatgcatctaccatgtggagctttagctggtttatttggccagaccatcacttacccattggacgttgttaggagacaaatgcaggtagagaatctgcaacctatgacgagtgaaggcaacaacaagcgttacaagaacacatttgatgggcttaacacgattgttcgaactcagggttggaaacagttgtttgctggtttaagcatcaactacattaagattgttccatcggttgcgattggattcacagtctatgagtcgatgaagtcatggatgcgaattccaccgcgcgagagatcaaagccagcatgagggtctttgttccttcactctctttagtctagaatac

SEQ ID NO: 864 - DNA, 1205 bp, Arabidopsis thaliana
cctcacttctctctctctctcttcataatcttttcattgatcatcgaccaaccaaaaacaaaaaaaactcaaaaaatccaaaaaaatcagatctttgaaagcttttcttttgtaacactcgaaaaatggatccgtcctgtgcaaactcagtgaacggattctactcatttctaaacagatcaatggaagatctcgaaagagtttatctttcaaacaatttcatgtccgtacacttcttacagagagctctctgtcttctccgtacctctcactctcatctcactctcttagttcaaaaacttcaacttcccgtcggtgacaaatggctcgatgagtatatggacgaaagctccaaactttgggaagcttgtctcgtcatcaaatccgccgtctcctccgtcgaaaacttctcctccgccggaatttcgatcgcttccaccctcgaccgtcgtctctctcctcagctttctcgtcaggtgataagggcgatatcaggatgtagaagagaagcgatagggatagaggaagaaaacagagcattaatggagaacagagttcaaaggtttccgttttggtcggaacaaacgtcggcgacggcgatggagtcgtcgacgaagttacaaaacgggttcagtggttttcgcggcgtgctttacgcgacgaggaacatgagttcgcttctccttatggttttaatgaacggtctcgtctactgttttcccggagacgcggcaacgcaaacgcagacgcagataacgcaaacgcagagtcaagtcggaggtttcgccggagcaatggggaggttgcagcagagagtggcggctgaggttgggaggatggggataaggaaaggaatattgatgcacgagtatcgccggagcaaagcggcgttggaggagcttaaagcggagctggagcggcggttctgcggtggcggtggtggtgggggagagagggaggaggaggaggaggacgagagggagctgagagagagagttgagaatctgaaagggtattttggtaatttaaggaatgggacagagagtatagtggcgcaaatcgatgatttcttcgatgagattgttgaaggaaggaaaaagcttttggatttctgcagccatagatgatgaaatatcaaaagctgacattttgttttttatgtttacatgaaaaaaaaaaaaaaaagttgggttaggctttaggct

SEQ ID NO: 865 - DNA, 906 bp, Arabidopsis thaliana
tgatctacacagaatccatttccgcaaatcggattcatgtttttgctttatcgtaggcttccttcatttgcacgaacaacaacaacaacccttctctgcaaatctatggagcctgcgataacagcgacttcttcttcttctttcggtggtggctcttctcgtctcgccgctttagcccagcaacttcgccaatacaagcccccaccttcttcatcgttcgatgactccgaggagatgcagacagatcaggagaccgctgggaaagtcgtttctcaggttgggtttcaggaatctattgctcctctttcgaaagaccctgataggtttaaacccaagagagccgctgtgttgatctgtctctttgaaggagatgatggtgatttgcgtgttattcttactaagagatcttccaaattgtctactcactctggagaagtttcattgccaggtggtaaagcggaggaggatgataaagatgatgggatgactgctaccagagaggctgaggaagagattggattggacccttctcttgttgatgttgttacttctcttgaaccatttctgtctaagcatcttcttagagtaattcctgtgataggcatcttgagggacaaaaataaattcaatccgataccaaatcctggggaagtggaagctgtgtttgatgcacccttggaaatgttccttaaggatgagaatcgaagatctgaagagagagagtggatgggtgaaaagtatttgatccattactttgactacagaacaggagataaggattatatgatatggggtttaactgctgggattttgatcagagctgcatctgtgacttatgaaagaccacctgcttttatcgagcagtgcccgaagtttaagtaccctaaaatgtgaatggctgaatga

SEQ ID NO: 866 - DNA, 1482 bp, Arabidopsis thaliana
cctaataatggcttgcagagcaaaagaacttgtgtcgttaatcttgtataagatctgtaatcccaaaaggtctgattccaaaattgaggaacatgtggaagaagtagaggatttgaaagcagaggcagaactctttaggtctggttccaaaattgagaagcatgttgaagaactagaggatttgaaagcagaggcagaactctttaggttgaaagcaatctcaggaacagaggaactgaaagcagtggcagatgtcaagaggttgagaacaatcttagaaaacaatagtggaacctcagaggagtgtaagggtgagatgttgaaagaagatctttttcttccctcggatcttgtacgtctcatattgtctcgtctttctttcaaagacaacatacgctcttctactgtttgcaaggcatggggtgatattgctgcttctgttcgggttaaaagtcgtcgttgctggcttttgtaccatgatgcatttcaagacaagggcgtctcttacggattttttgacccagttgagaagaagaagacaaaggagatgaatctacccgagctatctaagtcttcaggtatcctttattccaaggatgggtggttactcatgaacgactctctttcactaattgccgacatgtactttttcaacccgtttacccgagagcgtatagacttgcctagaaacaggataatggaatcagtgcacacgaattttgctttctcttgtgctcctacgaagaaaagctgcttggtgtttggtataaataatatttcctcatctgtagcaatcaaaatcagcacttggcgtcctggtgcaactacatggctacatgaggacttccctaatctgtttccttcttacttcaggcgcttaggaaacatcttatactcagatggtctcttctatacagcttcggaaactgcgctaggggtattcgatccaactgcacgtacttggaacgtacttcctgtgcaacccatccctatggcgccccgctcaatcaggtggatgactgaatatgaaggacatatttttcttgtagatgcatcgtctctggagcccatggtgtataggcttaaccggttggagtccgtttgggagaagaaggaaacattggatggttcctcaatatttttgagcgatgggtcttgcgtgatgacctacggcctcacagggtcaatgagtaacattttgtatttctggagcagatttatcaacgagaggcgttccaccaagtctccttgtcctttcagtagaaatcacccctacaagtattccttatatagcaggagttcttgtgaagaccctgaagggtactactttgagtatctgacctggggtcagaaagttggtgtctggatcgagccgccccacagcatctctatctatgattattccattcttgatccctccgaagcagtaaatacagagtacgtatttatctgaattttcagcttgatttagtctcaagattt

SEQ ID NO: 867 - DNA, 1334 bp, Arabidopsis thaliana
gcaagaaagggactaaccaagacgccatgctcgtctttgagaacttttgttcgagagacgatacagtgttttgtggtgtattcgatggacatggaccatttggtcatatggttgccaagaaagtccgagatacattgcccttcacactcttaacccagttgaaaatgacctcagagtcagatcaaagcagcttagttggtgccaatggttttcagatcaaatgtacagaggaagaagaagtgcagacaactgagtctgaacaagtgcagaaaactgagtctgttactactatggatgagcaatggtgtgagttaaatccaaatgtgaacaacgatgaacttccggagatgtatctgcctcttaaacatgcgatgctcaagtcttgtcagcagatagataaagagctgaaaatgcatccaactattgattgcttctgcagcggaacaacttcagtcactttgatcaagcagggtgaggatttggtggttggaaatattggtgactcgagagccgttcttgccacaagagacgaagacaatgctttgctcgctgtacaattaactatagacttaaaaccggatttgccaggtgaatcagcgagaatccagaaatgtaaaggaagagtctttgcattgcaagacgagcctgaggtagctcgtgtatggttaccaaacagtgattcacctggtttagcaatggctcgagcttttggagacttttgtctcaaagattacggattaatctctgttccagatatcaactatcgccgcctaacggaacgagaccaattcattattcttgctagcgacggggtatgggatgtgttgtcgaacaaagaagctgttgatatcgttgcctcagctcctagtagaagcacagcggctcgagctctagtggacacagcggtacgatcatggagaatcaagtacccaacttccaagaacgatgactgtacagtagtctgtctctttctacaagattcatcagtagccatggaagtctcaaccaatgtaaagaaggattcacccaaagaagagtctatagagagtgtcactaacagcacaagcaaggaggaggatgagattgtccccgttaaagacgagaaaatccctgagagttgcgggattgagtcgaaaatgatgacaatgacacttgcggaatgtatctcggttgcacaagatgatgaagagtggtctgctttggaaggattgacgagggttaacagtctcttgagcattccaaggtttttatctggtgagctcagatcaactagttggagaaaatggttgtgacttttttttgacttaagtgattctaagttaatgccgacatag

SEQ ID NO: 868 - DNA, 1944 bp, Arabidopsis thaliana
cttgcttcaagattcgagtgaggaaaattttagctgaaaatgctggaaattggaagtcccaatgctctgtttttccgtacgaatactacttgtaataatcttctccgtgagcttcagaaaatatgggttgaaattggtgagactgagactgagaaagatagaatgcttatggaattagagagagaatgtcttcaaatctatcaaagaaaagttgatgaggctgcaaattctaaggcaaagcttcatcagtctgttgcatcaatagaagctgaagttgcttctttaatggctgcccttggtgtgttaaacatcaactcaccgattaaactggataaaggttcaaaatcattgaaagaaaagcttgcagctgtgacacctctagttgaggaattgagaattcaaaaagaggagagaatgaagcagttttccgatataaaggcgcaaattgagaagattagtggggaaatctcaggatacagtgaccatctcaacaaggccatgaacatttcattgactcttgaagaacaagacttgactttgaggaaccttaacgagtatcaaacacatctccgcacacttcaaaaggaaaagtctgatcgtctcaacaaagtgttgggttatgtcaacgaagtccacgcactatgcggtgttcttggagttgactttagtcaaacagttagtgcagttcatccaagcttgcatagaacagaccaagagcaatctacaaacattagtgatagcacattagagggtcttgagcacatgattcaaaagcttaaaactgaaagaaaatcccgatttcaaaagctaaaggatgtagtggcttcactcttcgagctatggaatctaatggacacaccacaggaagacagaactaaatttgggaaagttacttatgttgtaagatcatctgaagctaatatcactgagccgggaatcctttcgaccgaaacaattgaacaggtatctacggaagtggacagtctcagtaaactgaaagcaagcagaatgaaggagcttgtaatgaaacgaagatccgagttagaggatctttgcagactaactcacattcaacctgacacaagcacttccgctgagaaatcaacggcattaatagattctggattagtggacccttcagagcttcttgcaaatattgaaatgcaaataaacaaaattaaagacgaagcacagagtcgaaaagatatcatggacagaattgaccgttggctctctgcatgtgaagaagaaaattggctggaagagtataatctggatgagaaccggtatagtgctggaagagggggacatgtaaacctcaagcgtgcagagcgagctcgggttacaatcaataagatccccggaatggttgacactcttatcaagaaaacacttgtgtgggaagaagacatgcagaagtcatttctatacgacggtgttcgattggttaacatactagaagactataaactgacaaggaaacaacaggaagaggaaaagaaaagatacagggatcaaaagaagaggcaggatctcctactaacccaaagggaatccatttacggatcaaaaccgagtccaagaagaagcagcagcttcagaaagcccaatggtttcaacattagcaatgggaatggttcagtgcctcccacgcctcgtagaggctcggtagggacaacaactcctgacgttcttctaaccccaagatcttactctggtcatcatcgccaaaacgggtatttcaaagaagttagaagactctctactactcccttaaactatgtggccatgcaaaaggaagatactgtttctactacctacacatcgatttatagctctgagccagactcgcctctccaaggctgacttgactctcttttccaccggatttgtggagtaatgttaatggtaaaaaaagaaggaagtgaagaagaaggaaggtag

SEQ ID NO: 869 - DNA, 3288 bp, Arabidopsis thaliana; identical to SEQ ID NO: 28

SEQ ID NO: 870 - DNA, 1665 bp, Arabidopsis thaliana
gaggaggagactaggaagatcgattttatcaatctcaattgaacaagatgtcgactctgttagctacatgtaaccaaaattgaaaccaaaactaagtttcttcttttgtagccttcttcatcattcaaaatatggcgaatagtaagtacgagtacgtgaagtcattcgaagtagaagacgaagttatgtttcccaatctgataattatccgtatcgatggccgtgatttttccagattttctcaagttcacaagtttgaaaagcctaatgatgagacatctctaaatttgatgaattcatgtgcatcttcggttttagtagagtatcctgatatagtctttgcatatggatatagtgacgagtacagctttgtattcaagaaagcatcaagattctaccagagacgagccagtaagattctgtctttggtagcctcattttttgctgcggtctatgtaacgaaatggaaagagttctttcctcatacaaaattagaatatgctccttcatttgcttcaaaagttgtaagttgtgcatcggtagaggttcttcaagcttaccttgcgtggagacaacatgactgccacatcagtaatcagtatgacacatgtctttggatgttagtaaaaagtggaaagaccttaagtgaaactcaggagattttgaaggatacacagaaacaacagagaaatgagcttctttttcaacaatttggtattaattataaaatgcttcctgtattatttcgtcaaggatcatgcctttttaagacaaagttggaagaaactgtaaagcatgatgagaatggaaagcctgtaaaacgattgaggagaagagaaactttagtgcattcagaaaatgttgctggaagaagcttttggaatgagcactcctctcttcataaagatcttggacattttgcaaaagacattggcaaaattgaaccagattatgttaagtcgtttcagtttgagagtagattattacctttaacttgggttgtggttaggattgatggctgccattttcacagtggctgttcttgaggagtttcaggatattgcctttgcctacggcgttagtgatgagttcagctttgttcttaagaataaatctgagctttacaaaagacagtccagtaagataatatctgcagtagtatccttcttcacatcgacttacatgatgagatggggagattttttccctcacaaaaaattgaagtaccctccatcattcgatggacgagctgtttgctatccaacatcagatattctcctggattatctagcttggagacaagtcgactgccatatcaacaatcagtataatacatgtttctggatgcttgttaagtctggaaaaagcaaaattcaagcccaggattacttaaagggtacccagacacgagaaaaaaacgagttacttagccagcaatttggaattgagtacaattcattacctgtaatcttccgcatgggttcttccgttttccgcctaaagacgcaggaaggtgttacagaggagaatggagaagtttcaggaaagcaagtggaagcagaagtgggcgtagactattcaaacattatcgaccaatgtttctggcaacaacatcctcacattcttagcttctcctaagacaggtattcattgctaccaaaatag

SEQ ID NO: 871 - DNA, 3175 bp, Arabidopsis thaliana
ttttcccgaatctattcatcacttgctactatcagtttgcttcttctgttctgtgtagatttccttggagggggtttgttttgacgcagtttcgttgcaaatgaaggaagatttagtgcccgagtcgaacagttcggtttggcaatctccggttaagcggttggctgtagacggcgagtgtggtgaggctggtgataggagtaggactagctgtaagagaattaaaacgactcaagtcaatggttttattgtttacactagaactaggaagactaaattcaccaagcttcatgaacaagaagatgaaaatgctggattgtcgaatcatctcgaggagtcgaaaccaacgagtggtgttacaagtggcttcggtggtgatatgtgtcgcagcagctcggtaggtgaaactaacgttagtgggagctcttgtgttaagaatacacttgttgagagctcctccgggaaagtcgttgtgatagagcggttagttactggcggcttagctgaaagtccggcagttgagactgacagtagctcattagtggatgttgtaattgacgacatcaattttgtggaattgttacatgaagcgattcctgttgaaattctgtctgaaggaagcctggattttgaggtgaaaagactaggaactaaagttagaaccatgggaaaatcctatagcgtctcggagaagaaaaagcatggatcttttaagcgtacagcacagatctataaatctattgtgagaatgaagaaggtaaataatttggtccctgagaatgtagaggttcttgcggaaccagactttggccgtgagggattagatgaacagagtcattctgtcagtcttgcggacaagtccattttaatccgcagcaggccagaaacagtgagggatctttttgagaccggtttactcgatggtttgtcggtggtttacatgggtactgttaagtctcaagcctttcctctccgtggcatcattagagatggtggaattttgtgctcatgttcctcatgtgattgggctaacgttatttcaacttccaaatttgagattcatgcttgtaaacaataccgaagagcatcacaatacatttgctttgagaatggtaagagcctgctagatgttctaaatataagtaggaacactcctctacatgctctcgaagcaacaattctggatgctgttgattatgcatctaaagaaaaacgttttacctgtaaaagatgcaaaggtcccttccctttctcctctcttggccatagagggtttctgtgtaagtcatgctcggaggtagaaacttctcaggccagccttgctgcgacaaggacctcaactagtgctcctgcgtgcataacatctccggttaagagtagattgaagataacaagaaagccatcagaatccacgtcaatatcaccagtatttatgtcatcacttggaaatagcactcgaaagataacaagaaaggctttacgtcaagctttggttgggaaggcttatctcagtgcttctacaaatgtatcttcacaaaagaagtgccgatcaaaatttaagaagatgttgacccaacattctgtgacccccaaggctttgaaaagtgtgtccctttccgtttcttcgaaaaagaggagttatagattagcaagaaaggatcaaggattgcacaagttagtgtttgatagagggggattaccagagggaactgaactaggctactatgctcgtggacagaaattgctcggaggctacaaaatgggcgctggaatatattgttactgttgcaagtgcgaggtgagcccctctctgttcgaagctcatgcaggctgggcatctcgtagaaaaccttatttttacatatatacatctaatggtgtatctcttcacgaatgggcaactactttctcacatggtcggaaatattctgctaatgataataacgacttgtgtgttatttgtgctgatggtggaaatcttttgctctgcgatagctgcccaagagctttccacatagaatgtgtttcccttccgagtatacctcgtggtaactggcattgcaaatactgcgagaataagttcacgagcgaaattgctggagagtacaatgtcaattcttctgcagttgggcaactagaaggagttgatcctgttgatcaattagctggacgatgcattcgcgttgtcaagaacatggaagctgaaacaaatgggtgtgtattatgcagtggttctgatttttgtagatcaggatttgggccacggacaatcataatatgtgatcagtgtgaaaaggagtaccacattggatgtttgagtagtcagaatattgtggatttaaaggaattacctaaaggaaactggttttgctccatggactgtacgaggatcaactccacattacaaaagttacttcttggtggggcggagaagctttcagattcttctttgggaataatacagacgaagcaagagagaaatgatgtatattccatcagtgatcttgacatcagatggagactgatcagcggcaaagttacttctcctgaaagccgaatgttactgtctcaggcattggctatttttcatgattgcttcgatcctatagttgatccactttctgggagcaatcttattccgagaatggtttacgggaagactatgcaaggacaagactacgggggaatctgctgtgctgttttgactgttaatgcgactgttgtttctgctggactattacgagtatttggccgagaggttgcagaacttccattagttgcaacacgcatgtgcagccgagagaagggctactttcaattgctcttttcctgcattgagaagctactctcatccctgaatgttgaaagcatcgtggttccagcagctgaagaggcagagcccttatggatgaacaaatttgggttcagaaaacttgcacctgaacagctcagtaagtatataaagatatgctaccaaatggtgaggttcaaaggagcatccatgctgcagaaaccagtcgattcacaccaaatcattgacaagacaatcgaaaccggtgcatctttagaagaaaattttgatttgaaacaagccaatgagttgtatgttcatcctttgtgttgaggcaaagcaagtcatggatttagtgaaagatggattaaagggtgaagcgtt

SEQ ID NO: 872 - DNA, 4794 bp, Arabidopsis thaliana; identical to SEQ ID NO: 31

SEQ ID NO: 873 - DNA, 2058 bp, Arabidopsis thaliana
tattgagcagccgtgaaatcgatttaccaattgaagcttccccccatgatttgactttccctgatgctcgtttgtgggaaagggtttctaaagtgcagagcacctggagttccattcttttgtgacaaaagaaaatccttcttcactaaaactaagaggggctttcacagtttacctttgggcactggggtccgtgtttatttcaacaacaatcttaggtactcaagcaattcaatagaagttgtggagaaagctgccattaatatgggttcaaaggaagacaaggcagataatccagctttatcttcatatgatgatgccatggaagctctgtcgactcttatttctcgtcgaaaccgtggggatcgcacacctactaaaggaaatcgtgacaagcttgaacaagtcgtcacatatctcaagattttggacctggaagacaaaataaaagaactaaaagttattcatgtcgcaggaacaaaaggaaagggttcaacatgtgtcttcagtgaggcaattttacgtaattgtgggtttcgaaccggaatgtttacatctcctcacttgattgatgtgagggaaagattccgaatagatggcttggatatatctgaggaaaagtttctacagtacttctgggaatgttggaagttattgaaggagaaagctgtagatggtcttaccatgcctcctctttttcagtttctcacagtattggcatttaagatttttgtttgtgaaaaggttgatgttgctgtcattgaagttggacttgggggaaaacttgactcgacaaatgtgattcaaaaacctgttgtctgtggcattgcttctcttgggatggatcatatggacatattgggaaatacgctagctgatattgcctttcataaggctgggattttcaagcctcaaatccccgccttcacagtaccacaactctctgaagcaatggatgttcttcagaaaacagctaataatctcgaggttcctctagaagtagtagcgcctcttgaacctaaaaagttggacggagttacgcttggcttgtctggggatcatcagctagtaaatgcaggtcttgctgtttctctttcaagatgctggcttcaaagaaccgggaattggaagaagatatttccaaatgaaagcaaggaaactgagattcccgtggcattttgtcgtggtcttgcaacggcacgtcttcatgggagagctcaagttgttcatgatgtagtttcagatccgcaggactcatcagactcgatggaaactccatgcggtgatctgatcttttacttggatggtgctcacagtccagagagcatggaggcttgtggtcgatggttctcttctgcagtcagaggagacaaaagcttatccactgctgtcaatggttacatgagacatggggagtatggtacagacttaaacagagtctccaaacagattcttctgttcaactgcatggaagtgagagaccctcaagtcttacttccaaagctggtcaccacttgcgcttcctcaggcactcatttctcaagagcgctttttgtcccgagcatgtctacttacaacaaagtcatttcgggtgcatcagcgattccttcagatacacgtagaaaggatttgacttggcaattcagactacaaagactatgggagaaatcaatccaagggactgatgcggggcttgaccatacactgaaacccgatggaataaccgccttaccacctcatgatttcctgtgcggagatgcacctcaatgtggtggacctgcagggacaccggtcacttccagtgccgtaatgccttcacttccattgactataaactggctaagagactgcgtacgccgaaacccttcactgaaactagaggttctggtcacaggatcgctacatcttgttggagatgtgctcaggttgctaaagagatgattttatttttcaccaacaaatcttcaaaaagactccttaagagtaatcttacagagcttcaattgttctttacttcactgtttttttctcatagttactatttgattctttggtcca

SEQ ID NO: 874 - DNA, 1935 bp, Arabidopsis thaliana
tcaggatctatgggcaagtctagtaagaaatccgtcaccgaagttgaaacacctgcttcaatgacaaagccactcaagaaaggtaagagagatgcggaagaggatttggacatgcaagttacgaagaagcagaagaaagagttgattgatgttgttcagaaggagaaagctgagaaaacggtacctaagaaggtagagagtagcagttctgacgcttctgattctgatgaagaggagaagactaaggaaactccatctaagttgaaggatgagtcttcttctgaagaggaggatgactcttcttcagatgaggaaattgcgcctgcgaagaagcgaccagaacctattaagaaggctaaggtagagagcagctcatctgatgatgattctacttcagacgaggaaactgcccctgtgaagaagcaaccagcagtccttgagaaggctaaggtagagagcagctcatctgatgatgattcttcttcagacgaggaaactgtccctgtgaagaagcaaccagcagtccttgagaaggctaagatagagagcagctcatctgatgatgattcttcttcagacgaggaaactgtccctatgaagaagcaaacagcagtccttgagaaggctaaggcagagagcagttcatccgacgatggatcttcttcggacgaggaacccacccctgcaaagaaagaaccaatcgttgttaagaaagacagctcagatgaatcttcttcagatgaggaaacccccgttgtgaagaagaagccaacaacagttgttaaggatgccaaggcagaaagcagttcatcagaggaggaatcttcttcggacgatgaaccaacacctgccaagaagccaacagttgttaagaatgctaaaccagctgcaaaagattcatcatcctcagaggaagattctgatgaggaggaaagtgatgatgaaaaacctcctacgaagaaggctaaagtttcatcaaaaacttctaaacaagaaagctctagtgatgaatctagtgatgaatctgataaggaggagagtaaagatgagaaagtgacaccaaagaaaaaggattctgatgttgaaatggtggatgcagagcagaaatctaatgcaaagcagccgaagacacctactaatcagactcagggaggatcaaagacgctatttgctggaaatctttcctatcaaattgcgagatctgacatagagaatttcttcaaagaagctggtgaagttgtcgatgttagactttcttcatttgatgatgggagttttaagggatatgggcatattgaatttgcttctccagaagaagctcagaaggcattggaaatgaacggtaaattgttactaggccgcgatgttcgtcttgatcttgctaacgagaggggtactccacgaaacagcaatcctggtcgcaaaggagaaggaagccaaagtcgaacgatttacgttagaggattcagttcttctcttggcgaagatgaaatcaagaaagagttgagaagtcattttagcaagtgtggagaggtgacaagggttcatgttccaacagatcgtgagactggtgcttccaggggctttgcttacatagatttgacgagtggattcgatgaggcgttgcaactgagcggaagtgaaattggaggagggaacatacatgtggaagagtctagaccaagagatagtgatgagggccgttcctcaaacagagcacctgctagaggagcacctcgtggccgtcactcagatagagcacctcgtggaggacgtttctcggatagagcaccacgtggacgtcactcagatagaggagcacctcgtggccgtttcagtacgcgtggaagaggacccagcaaaccaagtgtaatggaatcatccaaagggacgaagacggtctttaatgatgaagagtagaagaaagctgtttag

SEQ ID NO: 875 - DNA, 2528 bp, Arabidopsis thaliana
gcgatagatctgacgaatgcagatctaaaatgtcatctagaggaagggagaggatgatgatgaaggaagacggtagaggaaggaatccaccgtcgcgacatctttgggttggtaaccttcctcatgggatacttgaacgagaattagccgatcggttcttaagatttggtgaattggaaagcttagcgtttcagcctggacgaagctacgcatttgttaattttaatcacgatgaggatgcgttcgctgcgattgagtcgcttcaaggcttcccactctctggaaacccacttaggatcgagtttgctaaggcggaaaagtcatcaactggatcacgcactgatgatatatatcgccatgatgaacagcggtctgcagcaagagggtcgtcttttgtccaaagggactccagaatgcgttatgagagcccagacacatatagcaaatcaaaaatgaatgatagaaatgcagaacccagtgaggtactatatatagggtttcctgcttcgttgaaagtagatgatgcgctcttgaggaacgtcttttcttcgtttggagaaataacaaaggtcacggtattccctggtcgcagttatgcatttgttcaattccgaaatctgatggcagcttgtaaggcgaaagaaagtcttcagggaaagttatttggcaatcctcgagtgcatatttgttttgcaaagagtgaaccttcctcatctggcagtggaaggggtccgtcgggtagatcactctctccaccttacagatctgttgatcgactgggatcttcagaaggttatcttcaggatagaaactatggaagcatcagcagaattcccagtgtgagggaaccacattacatagaagatagggatttagaagattctgaaggttacatttttaacaggaaacgagactcaagtagcgatggaggtcctgcatatggaaggtcgagatctacgcatagatttcctcaggatatgcatgaatatcatggtagtcctggggaaatgggtacttcattccgtgataatcctcacagattccagacaaggagttcagagtatgaagagccatgggatctacccgaagatgactactactaccaggaaatcaagagattgaagacaagatcctcgcagcctgagaggcagctcccagggcatcagctttctggtatagagcaagaaagacgccccttttcaagggcatctgctgatttttccccaaaagatgcatttgagcggaactatgaggctggacagctaagatacaaccaaacagttgagcagccgttaaacctggctataaggaatggggacaagagtagcttacgagaaccacatgaagagttaatgggaggttatcctctgccatcagttgtccctgaaagaaaaaggtacacccctgaactgaatcgaccatcactaaaggactggaactgggaagggactattgctaagggaggcaatcccatttgtcgagcaaaatgctttcctgtgggcaaagtgatggacatgatgctgcctgagtttctagattgcacggcaagaactggtttagacatgctggctaagcattactaccaatcatctaaagcatgggtggttttctttgttcctggaagtgatgctgatatcgtgttttatgatgagtttatgcattatctggaggagaagcaacgggcagctgtttctaaattggatgacacaacaacgttgtttctggtgcctccatctgatttctccgagaaagtacttaaagttcctgggaaactaagcatctctggagttattctacgtttagaatgtggtggttctggctccggtgggcctgttcaacagcaaggtgagagaaaagatacagacttgctaacttattatggtgaaacatcatattcagaagctagtggagcgtttcctgatgtgggaaacccacgtattccgggtccaacagcttttctgcgtagtgcgggtcgtgacaatcaaagtgcatcaatggatccatacgtcgaggacaagcatgatcagttgagtcaccggtattctggatcggactggccgcctcgtgatacaaaccccagaagttcacccttcatagatcatactgttcaaaaacacagcgggtttgttcctgggaaacagcaaaatgcagatctaagtcgttatcatgatacggaaactccagtcccagcagggtttcagcctgaacagcttacacatttagcttcctcgctacccagacagcaacaacaggtacagaacactccaaatcagcctgagagatatgcaccagaaggccgagcaagtttcagccatttgcaacatgcgcagacaccaagcatacctcaattggtaactccacaaaatcaaaatgtacagatacaaagtagcaacagccaacaacaagaagaaacagaggctaatccacagaagcgtcttcaagcaacattacagctagcagctgcacttctccagcagattcaacaagctaaaccgagttaatggtggcttcctgagtatgaaatctag

SEQ ID NO: 876 - DNA, 1516 bp, Arabidopsis thaliana
tctaccatcgacaacgagaaaccagaaaatgcaaagtcttagtcaacttggaccttcagagattttccttgtcgccagaagagaaaaacccagtacgagagcacagctttggtttacgggaagactctcttttagacaagaaacaaatgggattcgtttaaagaatagagtagagtttagtccaagacctgtacctccaaatctgatcgcagcagagaaagaagaagctaaagctgttttaactctattcttcaagaagcaaggtcttagcaacagtctctcttctcggttaatcaacaaatccgatctattcattgaccatttagtgtccaggctccattctgttcataaagctcgatacctcgtaggaagagagcttactacacttgagattcgagattctctcattccttacctcgaacaacttcatgaagaacatggtgatcttctcgctgagcttgttgtgagcttccctgatccaccagctgaacctagacttgttgcttcatctccagtttctgtcctaccacctcgtggtgacacagattctgctgcagacactcgtaaactcagagcggtgtctcgagtcagcgaacttgacacagaaggtgcattacgtcctcagaccctttaccttcttgacctcggtttaaacctcgagcagatcaaaacgatcactcgaaagttcgctgcctttccttattacagcctcgatggaaaaataaaacctgttgtggaattccttctagacctcggaattcctaaatcagatatccccacaatcctctgcaaacgcccacagatatgcggaatcagcctaaccgataacctgaaaccgacaatggcctttcttgagacacttggcattgacaagaaccaatgggcaaagatcatttcccgtttcccagccatcctcacttacagccgccagaaacttacttcaactgtcgagttcttatcacaaactggtctcacagaagaacagatagggagaatcctaacccgatgtccaaacatcatgagttacagtgtagaagacaagctccgtccaactatggagtactttagatcgctaaatgtcgatgttgcggttctcctacatcgatgtccccaaacgtttggattaagcatagagtcgaatttgaagccagtaacagagttcttcctcgaaaagggttttggtttagatgaaattggaatcatgatctctagatatggagctttgtacacattcagcttgaaagagaatgtcatgccgaaatgggattactttcagacaatggactatccaaaatccgagcttgtgaagttccctcagttttttgggtacagtttacaagagaggatcaagccgagatatgagctggttcagagaagtggagtgagactgctgttgaaccaggttttatcgctgtcgggaattgagttcgagaaagttgttaagaagaagatgatgaaacttgtgtctaataacgtaattgctgaacaaagtagtggtggtttgttgtgaatgtag

SEQ ID NO: 877 - DNA, 683 bp, Arabidopsis thaliana
gatcaatgttgttatctctcactcttcctcttcttattttgatcttcctcacttctgtttgattcctaataatggaacacgagggcaagaacaacatgaatggtatggagatggagaaaggaaagagagagcttgggtcaagaaaaggagttgagttaactatgagagtgttggctttgatcctaacaatggcggctgcaacagtacttggtgtcgcaaagcaaacaaaggttgtgtctattaagcttattcccactttgcctcctcttgatatcactactaccgccaaagcctcttacttgtcggcatttgtgtacaacatttctgtgaacgctatagcttgcggttacacggcgatctcgatagcgattctgatgatcagcaggggaagaagaagcaagaagttgttaatggtggttttgctaggagatctagtgatggtggctttgctgttttccggcactggagccgccagcgcaattgggctaatgggtttacatgggaacaagcatgtcatgtggaagaaagtttgtggcgtttttggaaaattctgtcaccgagctgctccttcgcttcctctcactcttcttgctgcagttgtgtttatgtttcttgttgttcttgacgctattaagcttccttaattattaattgtttctgttcttgtcgttttgtgtgattag

SEQ ID NO: 878 - DNA, 1049 bp, Arabidopsis thaliana
cgaagtgaaagtcgtgatggctccgtcgtatctgaaatcgtggtaattggtgatggagaaagacgataacagtgacaaggtttgtctttcagtgaaggagaaatatacgtcagagcagcctgaggaaatggtgacaaatctgaaggcatctgtaagagaattgagtgtgaaagtgaaagaacagaatcagagaaaatgtgatgctaaggataagttgcagcagttgcgagaaagaataagcaaggaagttgttgatgtttcagtccaggagttgataccgcttcttagatcactcaaggaatttgtgaaggaggaatctgaagtcaggtctcgttgtaatgttaaacgttctgctttagaagatgcagttcatgatttggaggagagagctggtaaggggcttgatggtgagattcaagaggaagatttagatggtttgttggttgtatctttagataatctcacttcagcagagaaggagcttggagcaacgctaagagagatagtctctctgaagcgacagattgacgatgtgccatgccaatctgaactcctccaatatgaaagaagattctcagagctgaatgtctgtattcaggagaaacttcaacaaactaggaagctctatgcaacatacaatgctcttttagaaatcaaagatttgatgcttaaggagacatcattattgaattccataggttcaccgtttcaagacgtgattggtactcctgctggccgtgtgaagcttattgattcaatggaaggagtcatgaaaggaatccaacagaagattggaaaaatacaacttgggcttcaagaagagcagaggctccgtgatgcttcaaaagaaaagtatatagctgcagctgcagagcaaagaaaatgctacactgtactaagagcataccaggaggaatgtactaagaatgagaggctgagaagtcatatatctgccatgaacgaacacctctgactcgaagaagggtttgaataaggatctgatctgtgaaccggatctctgatatctcgtccccttgagtctagaatac

SEQ ID NO: 879 - DNA, 2458 bp, Arabidopsis thaliana
attctttcagttttccggtgaaaattcgccggaatccatggctgcgactctgctgcctcaatgctaccgtatctacaattccgatgcgtgcaagtgtgtttcttctgagaatcaccagacgacggggaagcgaaatgggaatcgaaatctcgaattcgactcgggaatttcgaaaccagcacggctagtacttcgagaccgatacaaggtaactaagcaggtcaatgatcctgcgctgactagggctttacgtggtttcgctgattcccgtcttatggaggatgcactccaactgttcgatgaaatgaacaaagctgatgcttttctgtggaatgtgatgattaaaggtttcactagctgtgggttgtacattgaagcagttcaattttatagcagaatggtgtttgcaggggtcaaagctgatacctttacttatcctttcgtgattaaatcggttgcgggaatttcctcattggaagaagggaagaagattcatgcgatggtgattaagcttgggtttgtttcagatgtttacgtctgtaattctcttatatctttatacatgaagcttgggtgtgcttgggatgcagagaaagtgttcgaagaaatgcctgagagagacattgtttcgtggaattccatgatttctggatatcttgcgcttggagatggctttagctcgttgatgctgtttaaagaaatgctgaaatgtgggtttaaaccggacaggttcagtaccatgagtgctcttggtgcttgttctcatgtgtatagtccaaaaatgggaaaagagatacattgccacgctgttcgaagtaggattgaaactggtgatgttatggtaatgacatcaattcttgacatgtacagtaaatatggtgaagtgagttatgcggagaggatatttaacggtatgatccagaggaacatcgtagcttggaacgttatgatagggtgttatgctagaaatggccgagtcactgatgctttcctctgctttcagaaaatgtcagagcaaaatgggttgcagccagatgttatcacatcgattaatctgcttcctgcttctgcgatcttagagggtagaacgattcacgggtatgctatgaggagaggctttcttccccatatggtattggaaactgctctgattgatatgtatggagaatgtgggcagttaaaatcagctgaggttatatttgatcgaatggctgaaaagaatgtgatctcatggaactcgattattgctgcctatgtgcagaacgggaagaactattcagccttggagctatttcaagagctctgggattcatcgcttgtacctgattccacaacaattgctagtattctaccagcttatgcagaatctctatccttgagtgaaggtagagaaatccatgcttatattgttaagtctagatactggtcaaacaccatcatcttgaattcacttgttcacatgtatgccatgtgtggtgaccttgaggatgcaagaaaatgtttcaaccacatcttgttaaaggatgttgtttcatggaacagcatcatcatggcatatgcagtacatggttttgggagaatttcggtttggttattctctgagatgattgcttctagagtaaatccaaacaagagcacctttgcttcactattagcagcatgtagcatttctggtatggttgatgaaggatgggaatatttcgagtcgatgaaaagagaatacgggatagatcctggaatagagcattatgggtgcatgctggatctcattggccgtacaggaaacttcagcgcagccaagagattccttgaagaaatgccatttgtgccaacagctaggatttggggatcgttgttaaacgcaagcagaaaccacaaggacataaccatagctgaatttgcggcagaacagatatttaagatggaacacgataacacgggatgttatgtcttgcttttgaacatgtatgcagaagctggaagatgggaagatgtaaataggattaagcttctcatggagagcaaaggcatatccagaacatcaagtcgcagtactgttgaggcgaagggcaaaagtcatgtgttcacaaatggagacagatcccacgtggcgacgaacaagatctatgaagtcttagatgtcgtctcgaggatggttggagaagaagacatttatgttcactgtgtctcgaggttgagaccagagactctagttaagagcagaagcaattcaccaagaagacattcggtaaggctcgccacgtgttttggattgatctctacggaaacgggaagaagagttacggtgaggaataacacgagaatctgcagaaaatgtcacgagttcttggaaaaagcttcgagattgacgagaagagagatcgttgtgggagattccaagatttttcatcacttctccaatggtcgctgctcgtgtggaaattactggtgaaaatag

SEQ ID NO: 880 - DNA, 3238 bp, Arabidopsis thaliana
attttcatttgttcgcttcgggttataagttaacttcaccgttggataaaagatgttcgtgaagaagttggtcgagatagcagccaagaagcctggaggaagttcatcagaaggactgagagctaatgacgttgagccacgtatcgctctgcattacggaatcccttcaggttctcacttgtttgcttatgatccatttcagaagatcctcgccgtttccaccaaggatggtagaatcaagttgtttgggaaagatcagacccaggctttgctagtctctgaagaaacatccacaagcaggtttcttgagtttgttcagaaccaaggaatccttctcaatgtgaattccaagaaccagattgaggtttgggacttagacaagaagcttctatctcatgttcatgttttcaatggcgagatcacttctttccgggttatgcaacataccccttacttttatgttggagattcttctggtaatgtatcagtgtttaagatcgaacaagattctaatcaagttatacaactggagtacaccataccttacctagcatcaaatggctctcccattgaagcttctgaggatacttcagttgtgagcattctaccacagctaacagctgaaagcaagaggattctattggtatttagtagcgggtttatagcgttatgggacatcaaagaaagcaaaccgattctcaaaacaggagtacacggtatggtaaagcaagatacgaagaaagcgacttgtgcttgttgggtttgtccttcaggaagcagagtttcagttggctatagcaatggagatattctaatatggagcattccttccaaaggagaatgctcgccagagagttctgctatgatttgcaagcttaacctcggatacaaatccgaaaagataccaatagcttctctgaaatgggtttatgctgaagggaaggcaagccgggtttatgtcattggatcatcctcaaactcgttgcaggtggttttgttgaatgagcaaaccgaaactcggatgattaagctgggacttcatgtttctgagccttgtgctgatatggagatgatcatagctgatgttaatgaacagagcaagcataaacaagattttctgtttgttcttggaaagtctggacgtgtctatgcttacgatgattatatgattgagaagtatctgattcagtctcagtccaaatcatctccttccctcccaaaggaaactgtggttaagctgccattttcagattcaagcagcattaccgtaggaaaattcctcacaaatccttcacacttactcaatctatcagatgaggattatgctcagctggcgaaagatgctgtgccgtttcttccttttcatacagttccaaaggaaagttcccgttctgcacattttcctggtttcacaaaggttaagaatgtttacatcacaggacactgtgacggaaccattagtgtatgggacatgacctgttcttttcccattcttgtcttgtttctgaaagaacagatagatcaagatgtatcttcacgcggaaatgcggcattgacagctttacattatgacagcaactcaagacttcttgtttctggtgatcataacggaatggttcgcctttataggttcaaacctgagccatacctaacagaaaacagttttatccctttccaaggaagcttaaagaaaggaaataaccatattgttcaaagtgttaagtacatcaagcttactggttccataacctgtattcagaagagccaaaactcaaaacatctcgctattggatcagatcaaggacatgtttctctggttgacattgaggaagcaaatgtgttatacacaaaacacattgcaagtgatatatgtccagggatcatctccttgcaattcgagagttgcattgtgcaaggcttcgagaagaacgtgttagtggttgctatgagagactcgtcggtttttgctctggacagcgacacgggaaatatgattggaaccaacatgattaagcctaaaaagccattcaaggttctgtatatgcagatcctagatggaaagcaagatacttcaggaaatggatttgatacgagcagagagagcacagttgaggagatctcgataaggcagccttcggttttggtttgttcggagaaagctatatatatctactccttggctcacgttgtccagggagtgaagaaggtcctccacaagaaaaagttcagttcttcacccatttgctcagcttccacattctatggaacctctggtgttggtcttacacttgttttcacagatggaactgttgagataaggtctttgccagaactctcccagctaaaacaaacttccattagaggcttcacatattcttcaccaaaaccaaactcgttaccagagattaccatatccgcttcttgggatggagatctagtcatggtgaatggagatgatgaacttattgttagctcagttttacctcaaaaggaaacttttaggcttgtcgagtccatgaatcgagtttacaagaaagataactcggtttgtcacgaaggaatcatcacatcatcatctccaagggaaaagaagagtatgtttggttctgttttcaagactaaatcaaagcgcacaactgatacagaaccagaaagctccaaggaaacgatcgaggagctgtctaaaatcttctctacagctaatttcccctggaacaacaatgttgagaatagtagagagatcaatacaattactagggtggaagatgaagaagagttggacatagatgacattgacattgacgatcatcatcctaatcaacaacaacaagagaagcctaaagaacaagggatattgtcagggcttagtaaacagaagatggcgaataggtttagtaatttcaaaggtaagctgaaacagatggcagctaagaatgagaagagtgttgtaaccaatgacgagaagcatgaggagaaaaacggcgccacagttgatcagatcaagaagaaatacgggtttacctcgtccgatgaaatgggagctgccaaaatggctcagagcaaacttcaagacaacctgaaaaagttacagggaattagcttgaggacgacggaaatggaagatactgcaaagtctttctcctctacggcaaaggaactactaaacgctgttgagttcaataaacagagctcaaaatcttagcactctttttctctggatgtcaaaattacctactgt

SEQ ID NO: 881 - DNA, 5507 bp, Arabidopsis thaliana; identical to SEQ ID NO: 40

SEQ ID NO: 882 - DNA, 567 bp, Arabidopsis thaliana
aaaataatggcagctttggcatcaaacccccaaatgctaactagacaagctcacggtaacaagaaggaacaattgtggaggaaagagagtttaaatttggagaagaagtgtgggttttgtgtgagcgtttacagtaatgaaaagcttgggaggtcacatatggagaaagagtggagactaaaagccttttggtcaaacatagctcagcctacgactttggagatggaacccattaacaacgttgaagaactcgatgctgttctctctcacgcacgccaactctctcagcctatcatcatcgaatggatggcttcttggtgtcgaaaatgtatttacttgaagcctaagttggagaaattagcggcagaatataataaccgagcaaagttttactatgtggatgtaaacaaggtccctcaaaccttggtgaaacgtggaaacatttcgaaaatgcctactattcagttatggaaggaagatgagatgaaagaggaggtgattggaggtcacaaaggatggcttgtcatcgaagaagttagagaattgatcaacaaatttgtctagtag

SEQ ID NO: 883 - DNA, 1674 bp, Arabidopsis thaliana
tttacgaaatacgccgaatcgttgacgagaatggagtttgacgaatacgagtacctggagaagacggttgaggaaggagctgggtcgaataagaaaaaggaagagagtgggaacgagaggagcgagaggagttacagaaagagagaaggaggagagaggcagggggaagaaggaggtgaagaagagcgggttagcagtcggagtaagaagtctcgcggagacggcgaagagaacggtggtggtaagagggatcgggagagagagaggcataggagcagcagagacaaggatagggagagggataaggttagagaaggatcgagagataaagagagcgatcgagagaggagtagcaaggagagagataggagcgatagagacaaaccccgagacagagagagaagagagagggagaagaggagcagcagtagatctcggagggaagagaaggaacccgaagtagtggaaagaggaagcagaagacacagggacaagaaagatgagcctgaagcagatccagagagagatcaaagaactgtttttgcatatcagatgcctcttaaagctacggagagagatgtttatgagttcttctccaaagcgggcaaggtgagggatgtgcgattgatcatggacagaaattcaagacgatcaaaaggcgtcgggtatattgagttttatgacgtgatgtcagttccaatggccatagctctgtctggacaactgtttcttggacaacctgtgatggttaagccctctgaagctgaaaagaatctggcccaatctaacagcactacggttggtggtacaggccctgcagataggaaactctatgtgggtaacctgcatttcaacatgtcggaactgcagcttagacagatttttgaggcatttggtcccgttgagcttgttcagctaccacttgatcctgaaactgggcagtgcaaaggatttggatttattcagtttgttcaacttgaacattcaaaggcagcacaaattgccttaaatggaaagctggagattgctggtaggacaatcaaggtttcttccgtctctgatcatattggtacacaagattctgctccaaaatctgctgattttgatgatgatgatggaggtggactggctttaaatgcacaatctagggctatgcttatgcagaagctggatcgttcaggtatcgctacaagcattgtgggctctcttggagtaccagggctaaatggagcagcgtttaatcaaccaggcatgaatcctagtttcccaacatcagtgcttccgacaacagcaatcccttcttttgtcaatgaacatgttggtctgccaagcgaatgccttctattgaagaatatgtttgatcctgcaaccgagacggaaccaaactttgatcttgaaatcagagacgacgttgcggatgaatgttcaaagtatggcccagtcaaccatatatacgtagacaagaacagtgcggggtttgtgtatctgaggtttcaatcagtggaggcagcagcagcagctcaaagagcaatgcatatgagatggtttgcacaaaagatgatatctgcaactttcatgcctcctcatgaatatgaagccaaagccaaggcctgaattgaagacaagtcggatttttgtctttagtagatttcttgttctaactgctatgcagat

SEQ ID NO: 884 - DNA, 2827 bp, Arabidopsis thaliana
cttcatattcaaatctcctctccctaactgttttatggtctcttggattctgaatttgggatcttggggtttcgggttttgaaccatctctttagactttagttacacttttttcattcttttttaagacaaaagagatacgatgaagtctggtctcatcataaccattgctctgttactatacacaagcagctttgttcttgtttctgtagcgaaagagtgtaccaacactcctacgcagctctcatcccatactttccgcagcgagcttctgcaatcaaagaacgaaactttgaagacagagttgttctctcattaccatttaactccagctgatgactctgcttggtctagtttattgccaaggaagatgttgaaagaagaggcagatgaatttgcttggactatgttgtataggaagttcaaggactctaattcctctggtaactttcttaaagatgtctctttgcacgacgttaggctcgacccagactcctttcattggagggctcagcagacaaaccttgagtatctattgatgttggatgttgatggtttggcctggagcttccgtaaagaagctggtcttgatgcacctggagattactatggaggatgggagagaccagatagtgaactccgtggccattttgtcggtcactatttgagtgcaacagcttatatgtgggctagtactcataatgatactctcaaggagaaaatgtcagctcttgtctcagctctatcggaatgccaacagaagtctggcacaggatatctctctgcttttccttccagttttttcgaccgctttgaagctataacacctgtttgggctccttactacaccattcacaagattttagctggtctggttgatcaatacaagttggctgggaacagtcaagctttaaagatggcaaccgggatggctgattatttctatggccgtgttcgtaatgtgataaggaagtacagtgttgaacgacattggcaatcactaaacgaagagactggtggcatgaatgatgttctttatcagctatacagcatcactggagattccaagtatttgctgctcgcacatctctttgacaagccttgctttctcggagtcctcgcaattcaggccgatgatattagtggattccacgctaatacacatattcccatcgtcgttggatcccaacaacggtatgaaatcactggtgatctactccataaggaaatctcgatgttctttatggacatttttaatgcttctcacagctatgcaacaggaggaacatcagtcagtgagttctggcaagatcccaagagaatggcgactgcactgcaaactgaaaacgaggaatcatgtactacttataacatgctcaaggtctctaggaatctgttcagatggacaaaagaggttagctatgcagactattacgagcgcgccttgaccaacggcgtgttgggaattcaaagaggaacccagcctggactgatgatctacatgctcccattaggtaaaggtgtttctaaggctgtgacttatcacggttggggaacaccttatgattccttctggtgttgctatggcactggaattgaatccttctcaaaactgggagattccatatattttcaagaagatggtgcaactccagctctttatgtcacccaatatatatcaagctcacttgattggaaatctgctggtctttcaatatctcagaaagttaatcctgttgtgtcgtgggatccgtacatgcgtgtgacattcactctttcttcttccaaagtgggagtggcgaaggagtcgactttgaatctaagaattcctgtttggactaactctataggtgccaaagtatctttgaatgggcgacccttaaacgtaccaacttcaggtaatttcctatcaatcaaacagaaatggaaatctggtgatcaagtaaccatggagctaccaatgagtatcagaaccgaagctataaaagatgatcggccagagtacgcatctcttcaagccatactctatggcccctacttgttagccggacacacgagcagggactggagcatcacaactcaggctaaacctggaaaatggataacccctatacctgaaactcaaaacagttaccttgtcacactctcacaacaatctggaaacgtatcttacgtgttttcaaatagcaaccaaaccatcacaatgagagtatcacccgagccagggacacaagatgccgttgcagcgactttcaggctcgtgactgataattctaaaccacggatttcgggtccagaaggactaattggaaggctggtcatgcttgagccgtttgatttccctggcatgattgtaaagcaagcaactgatagctccctcacagttcaagcttcttctcctagtgacaaaggagcttctagctttcggttagtatctggacttgacgggaagctaggaagcgtttcgttaagactagagagcaaaaaaggttgttttgtgtacagcgatcaaaccctaaagcaagggacaaaactaaggctagaatgtggttcggatgcgactgatgagaagtttaaagaggcagcaagctttagtttaaagacaggaatgcatcaatacaatccaatgagtttcgtgatgagcggaacacagaggaactttgtgttatcgccattgtttagcttaagagatgaaacatacaatgtgtacttcagtgtgcaaacttgaagaaagaaacccttattgggtgaaaatataagaaagaaaagtctcatttgaaatatagacatgtgtttagatgtttagcctcttaggtttgtttgtgat

SEQ ID NO: 885 - DNA, 1163 bp, Arabidopsis thaliana
agccattgttcttcatcatctccatggattttgattccatttctcgggaaagcacttttctttccccattgcttaaccaaaatgcaatgtggcaaatgaacttgggatcagatgatacaatgggtgttgatgggtcttatccggaacgtcacggagagccagattgtgcttattatataaggactggactttgtaggtttggttcaacttgccgattcaatcatcctcacgaccggaaactggttatagcaactgcaaggattaaaggagaataccctgaaagaattggtcagcctgaatgtgagttttatctgaagacagggacctgcaaattcggagtgacttgcaagtttcatcatcctaggaacaaagctggtattgatggaagtgtatcagttaatgtcttaagctatcctctacgtccgaacgaagatgattgctcttactttttgagaattggacaatgtaaatttgggggaacttgtaaattcaatcaccctcagactcaatcaaccaacttgatggtttctgttcgtggctctccggtttactctgctcttcaatctctaactggtcaaccgtcttattcttggtcgagaacatcttttgttgcaaaccctcctcgtttgcaagatccttctggtttcgcttcaggatctcaaggaggtctcttctcatccgggtttcattcgggaaattctgttccgctcgggttctatgcattacctagagagaatgtattcccggaaagaccaggccaacctgaatgccaattctacatgaagacaggagattgcaaatttggaacagtctgcaaatttcatcatcctagagacaggcaaacccctcctcctgattgtgtcttaagctcggttggccttcctttacgcccgggagaaccactgtgcgtgttctattctcggtatgggatctgcaagtttggtccaagctgtaaatttgatcacccgatgcgagtcttcacttacaacaacaatactgcatctccttctccttcatcatctctgcatcaagagactgcaatcaccacagagctcaggaatctcctagtctcttcttctgtggaagcaaaacccacatcactccctgaaacaacctctgctaaagacaccattgttgatgcacagcactgaaaaccctgttag

SEQ ID NO: 886 - DNA, 302 bp, Arabidopsis thaliana
aagacatgaagttcatgacactaatggtcatcacatttgtgattatcgtcctgtcatctcctattttgatgaaagcagaagagacacagtcatgtgttccgatggagctcatgccatgcttacctgcaatgaccaaaagagaacaaccgactaaagattgttgcgaaaatctgattaagcaaaagacatgtttatgtgattacattaaaaacccattatatagtatgtttactatctctctagtcgctcgcaaagttttagagacttgtaatgttccttatactagttgttaaagctcataa

SEQ ID NO: 887 - DNA, 404 bp, Arabidopsis thaliana
tgttcttgttcttcacgatgagaatcttgaaaactcaaagatccagaggaggaagaagaacaagcaagaaatttggaaacagaagaacaagtggaggagaaaagttctcggagaagcttcaggcgcttaagagtcttcttcctccgccgtcgaagatgacggagcagagtcgtcaagatgcttacgtggaagaagattccagtgttggagagacggaacagttgtttcaagaaactgcggattacattgtcagacttaggggacaagtcgtggtgttgcaaaagttaatcgagatttatggatcatctgatcagaaggaagataattttgtttcataatgttcatattaaattatgataatgtttttcattaagcttttttcaatgtgttacgtattttgaacc

SEQ ID NO: 888 - DNA, 669 bp, Arabidopsis thaliana
cgatcaacagactctaatcagcagcaaatgtggagcgtcaccggagcattgactgtggcggtgccgcctaccgccgccgcttgccgtacgaaaccctttctcatctcctcttcctttcccaagcagacaaagaaactccatctctcttcgccttctctgtctctaccatcatcacatttctcctcctctttcaaaaccgcagctacctccatcgagcaacagtcttctgttaacaagggagagagcaccaagtaccatttcctggtagcaaacgctaaattcatgcttgacgaagaggagcacttccaggagcaattgtttgaacgtctccgttacttcggtgagcgtgaattagtgcaagacttctggcttgtcattgagcctaaattccttgacaatttccccaaaattactcaaagacttcgtcgtcctgctgttgctcttgtttccaccaatggcacctggatcacgtttatgaagttaagattggatcgtgttctgtatgattcctttgaagctacctctcttgatgaagctttggcctccaatcctaccactcttgagttcgataagcctaaaaattgggtggcgccataccccaagtatgaacctggatggtgggataccttcttgcctaaagtaacccaagaatctgcagtatagaactaa

SEQ ID NO: 889 - DNA, 1032 bp, Arabidopsis thaliana
ttctctctgttcttgcactcgcaaatcgcaatggattcgtttgatttcgataacgtgaaagcagagaaagccaaggcgttgcggcgtttcaaccgcttctgtagaattggccgtttcttccgtgcggcggaggtttgcgtcgctctactcttcatcttttggacattttcgcaacttcctttcgtcgttcaaatctccggagcgtttctccgccgtatcgccgccgtcatatctactcctctgttcgttttcctcctcgggaactccatcgtcgttgttcttctcaccaagtcttccgatcagacaaccaccgccgtcgcaagcgcagaaaccgaaatctaccaggcgttcgtcagatctgtagagaatcgttccaaaccgtccgatgaagatttgacggaggggattgtctacgacgacaaacaggtgatcgttactgatttggattcaaatccgaatctaacggtggatgagaatatgcctcacgtcgagattgactcagattcgagtccccatagtaaggtctatggaagaagcaaatcagacgtgtctggaaaacagagttcaaacatggtgatgatgatgatgaaacgttctcttcagagatcggagacagagaagttctgcaaagaaactgagaacgatgatgactctgaggaggagaagaactatccagaggatgatctgagcaacgaagagtttcagaaaacgatagaagctttcatagcaaaacagaggatgtttcgtcgtcaagaatctttagccgtcgttgtccataacatagcctaaatatctttttatatctatatcaaaaaagcatcaaattctaatataaatcgaatcaaacaacaaacaaacaaagttttgtgaaagttaaccattatggaatcttgtttttttataaaaatattccatgtatgtagtataaatatcatctctatgtacagtaattttagttgcttatgtattaagaaagatatgtaatctacttgtctcaagtgagtgtcacttcctcagttttaatgatacaga

SEQ ID NO: 890 - DNA, 820 bp, Arabidopsis thaliana
ctctctctctctaatgggtaattgctgcgtcagctccggtaccaccgatcgggaaaacgagaacgtttccgacaagaacacaaccattgtcgaagaagagacagtagtcaaagaagtcttgtcagagacaaccttgttcactccttcctctagtttccgcacttcgacgttcaaagacccggtgaagaccaagatccgagaagatgaggagaaaaaacccggtttcttgaaaatggcttcagacccggttttgatccgacccggttcggttgatcctgaagaaggctctgaggtttcggagatttgtagcttgagtttgagcgagagtgtgtcttcaacggttgtgatgaatggttacgatgaggaacatgtgatgatgaaacagaggaaatctcagagatctccggcgaaaactcggacccaggtcaccggtaataattatccgacccggagaactgatcaatctccacgtaagagaaacaatggtacatgtaatggagcgagatacgggtcgggtgtgagagacccgggtgagagatccggaagaaggtcaagatcgccggcgacgaatagatcggtgatggattcgaatcagagtagtcgggtgggtggggcaaagactaggaagaataatcagtctccgggtcgggttagactagatccggctaaaaacgggttggatcagcaacagcatcagaattacggttataccacagaggaattgttagagaacccgcttgtttcgttagagtgtttcatatttctttgaaaaagaagaatatttcgatgggaataatgtcttctcatttgacgttggatt

SEQ ID NO: 891 - DNA, 916 bp, Arabidopsis thaliana
ttggatcagagaaaatatgtcgcgcgttctcacttgcccaccgcttgtgtttgcaagaaaccacgttggcgttcaaaacttggtcgaatcgactaagcttaaaagaatcacacttgattcaaaaaaggcgcaccggatagagaagaaggaaaagaaggagaagagaaaagaaaagaaagaaactaagcgtgagaaatcgcataaacattcgattaaagcaactgataatcatcacaagctaatatttcttccttccaagaaagtgtcagatgagtctgactcactagagaagagtggtttgacagatgagcttgaggaacctcaaaaacaccttggatatttgtctgatggaagtcagaatagtaagaagaggattagagatgattctcctccggctgttgaaagtctcatcaaagctgcacctgtagcaggtaaacctctacggattagaatggtcttcaaaaaaccaaaggaggaagttcctactctgcctagagaggctgttgtttgctccactacagttgcaaagtcgctcagtcaccaagatgtcataacaagttctatctcaagttcaaaaacatccgagcttgaaaagaatctgccgtcaacatcaatagcggcaatagatgaaacaaagaagagaaagaaacacagatctagcaaagaagatcaatacaatgcattgtttgatggttggactcctccttccatgtgtattgctgatgcatcttcaaatgacaatggtgattattggctatttgggaacaagacgcaagaggtgcttaagcccaaagcagcagtcaaggttgatgatgacacgatgatgagaccgggagattcatcttggcctagagctcaatttttgtctgaagttgggatttattctttaccttatactgtcccgttctaatgctaa

SEQ ID NO: 892 - DNA, 258 bp, Arabidopsis thaliana
ctaaaccggtaaaagatgtcgctagctatcgcagaagtttacacggtgaggaagtttcacagagagagtatgaagaaaccggccaaacagacggttaccggcgagggagatgaaaagattggcggaggaagtttcaaggaggcgccggtgaagtcaggtgggtgtagaagattcggacggtggttttttgggaagccgggaatgaagaaaagctctgctaaagtttcggatcccatggcgattgagtgatgaagaaga

SEQ ID NO: 893 - DNA, 264 bp, Arabidopsis thaliana
cacagagaaatcatggggttctggacactaatggaaggattgctactatttgcaaacgcactggctatcttaaacgaagaccgttttctagctcccaaaggatggacgctcgcagaactccaccaaacgggcaaaagaaactctctcaaaggccaaatcattggtctcatccacgcctgtcattacatgaggcttcctctcatgctctttaacttaattgtcattgtctttaagcttttctctggttaaaatgatcaaacctaa

SEQ ID NO: 894 - DNA, 808 bp, Arabidopsis thaliana
ctcattaatggaagtttcaacatcatccatgtcttcaaaaccagaacaaatgcaaaacccacctcctatgatctcatctcctaggtttcagcctcagataatatctcctcatcatcatgaccagcatcaacatctctcaaatccttatccaacaacatttgttcaagcagacacttctactttcaaacaagtcgttcagatgcttaccggctcatccaccgataccaccaccggaaaacaccacgaagctccttctccggtgaacaacaacaacaagggatcaagtttctcgattccacccatcaagaaaaccaacagcttcaagctttacgagagaagacaaaacaacaacaacatgttcgctaagaatgacctaatgatcaatacgttaaggcttcaaaactctcagagattgatgttcacaggaggaaacagcagtcatcatcaaagcccgagattctctccaagaaacagttcatcatcagaaaatattcttctgtctccaagcatgctggattttccgaagctagggctaaacagtcccgtgacgccactgagaagcaacgatgaccccttcaacaagtcatcacctttgtcattagggaactcatcggaagaagacaaagccattgctgataagggcttttatcttcatccatctccagtctcaactcctagagactctcagccactgcttcttcctctttttccggttgcttctccggcgaggaactcttaatcccgacgatatccatgagtgattttatacatgatattaaattatatctatctccggattttgtttagc

SEQ ID NO: 895 - DNA, 2271 bp, Arabidopsis thaliana
taagtttgtgagatggaattagtgtctggaaaagtagttccaggttgctccaacgcaggcaatcctttccatgagtgtactgctatctgttttgagagagtaaactctccagatgtccacaagaaggagaagaaactctttgggtttggtaagagaactcccagcagggatcagactcctccagctagtccggctcgtggaagcagatcacctctggccagctatttcgccaagaagaaggttgagtcgtcagcagagagttcaccatcctcttatgatcacaccaatggcaacttcttaagtcgcctttccccgctacagggacgcaagatcgagccttcaagcaatgtcgattcgctgccagtttcgccttctctcgctctatactcagggggagactactttgcaaggagggctgatcagcgtggagatgaggatgatgatgtatcaccaaggccttttggaactcagcctaagacccctgaacaccctcttaggacgcctcagcataggccacgcacaccgcaacaccgctctgcacaccaagaggacgctttttcactagaaactaggccgaggactcctgaacgccgatccaatacctctgatactaggccaaggacacccatacatgagtctgcggcaacaggaagaaggcctcaaacaccagaaactagaccaaggactcctgatcaccgatatgccacctatgataataggccgaggacacccatacatgagtctgctgcaacagaaaggaggccccaaacaccagaaactaggccgaggactcctgaacaccgatctgccatccctgacactaggccgaggacacctatacatgagtctgctgcaacaggaaggaggcctcaaacaccagaaactaggccgaggactgcacaacgtagagggaggtcacctgagttcatggaaagatcccccggaccaaggtccaagaccccagagcctcaacctacttacttcgaaccatcctcaaggactccaaaacagcggtccaagacgcctgaacccagccctaggattccccaaactcagcccatgtcccacagatcccttgacaacgctgctcttaaaatgcctcggacagttgaaactaggcctaggacgccagaacaccagccgaggactgtggaaacaaagccaagaatacatgaaagtaggcccaaaactgcagtctatggaggaaggtcacctgatcacagggaaaaaatctcacaagaaatgggtcaaagatcatctcatgcctacaattatcttgggagcaaagctgagtcagtgtacattgagaagaacgaggaatcagttctactctttccagaactgattttgtcacctcaagaaaggccaccctctagacttattacgcttaatcaccgaggatatgaaacacctaacaaacagaaagaacattgtgatgaaatggatgattctgcaagcacagacgacgataaattttcatttgtggatgatcacgacgaacacactgtttcaatttacgctgaaaccacatcgaaatctggaagcagcgaacaagaggaacagcataaagcaaacaacgagccaccggagctgccagatgaatcacagagcttcagtctcgctgagatctctcgtatgaaaggaataattaccaataatgaaataagggacgtgatgcagtctattctatctgagtcttacgtttctgtgggacagtacaaggtcagagctagcgtctcgaccactctacaacacatactccagaagcacggtgacattgcgtctggttccaaactacaatcgcttgctacacgatcctactacctcgacatgcttgcctcggtggtattcgaactccaaacaactcccctgaagtatctcaaggagagccgcgtggtggaaatggtagcgattgttaaagacattgagtccgtgaaaatcaaagcaggttggctcaagcctgtcctggaggagatcgtagaggcggtaaaacactacgatgaacacaagatgagcgtagtggagaaagaggtgtgggagagagatgtgttacttgcgaaacaagaaactgagaaacaggtgaaagaactgggagagaaggagaagaagataaaggagtggagagctaaaatgacggagatggctgcgaagttaggggatcttgatatgaaaagagctcgtctccacaaaagcttcacatttctgagctccaaggtcgacaagtttcaagggaaaccccttcttcaaggcatcttgtaaccaaccaattag

SEQ ID NO: 896 - DNA, 1534 bp, Arabidopsis thaliana
tggactgaagatgtcaggattcgaagatggattttcagctgaaaagctattctcacaaggatactcatacacctacgacgatgtgatatttctaccacacttcatcgacttttccactgacgccgtctcgctatccacgcgtctcagcaagcgcgtcccactctcgatcccatgcgtcgcttcgccgatggacactgtctcggaatcccacatggctgctgcaatggctgctcttggaggaatcggaatcgtgcactataactgcgacatcgatactcaagcttccgttatccgtcacgctaaatcgcttcaagttccgattgcgtctgatgctgtttttaaatgcccagagcaccagattggttctgttgatgattttggtccttcttccttcgtttttgtctcgcagacgggaacattgacaccgaaattgttgggttatgtttcaaaatcggagtggtcgagtatgaaagatgaccaaaaggaggtgaagatatatgattacatgaagagttgtgagaacaaagattactatgtgccatgggatattgatcttgacaagattgaggcggttttggaagataagcagaaagggtttgttgttctggagaaggaaggtgagactgtgaacgtagtaacaaaagacgatgtggagagggttaaaggatatcccaagttagggtcaggaactgttggtgcagacaagaaatggatggttggtgctgctatagggacaagggaatcagacaaggagaggctagagcacttagtgaaagctggagctaatgttgtggtgttggatagttcgcaagggaactcgatttaccagcttgagatgatcaagtatgtgaagaatacgtatccggagttggatgtggtcggtgggaatgtggtgactatgtaccaggctgagaacttgatcaaagcaggagttgatgggttaagagttggtatgggatctggatctatatgcacaacacaagaggtttgtgccgttggacgaggacaggctactgccgtgtacaaagtctcgacactagctgctcagcacggtgtacctgttatcgcagatggtggcatctcaaactcaggtcacattgtgaaggctctagttctgggagcatcaacggtgatgatgggaagcttcttggctggaagcaccgaggctcctggagcctatgaatatcgaaacggtaggagagtgaagaaatacagaggtatgggttcattagaagcaatgaccaaaggaagcgaccagagatacttgggagataccgcgaaactcaagattgcacaaggagtggttggagcggttgcagataaaggctcagtgttgaagtttataccatacacaatgcatgccgtgaagcaaggttttcaagatctcggtgcttcttctttgcagtctgctcacgagctattgagagataatacccttagactcgaggctcgtaccggtgcagcacagatagaaggtggaatccatggactggtgtcttacgaaaagaaatcgttttagctttccccagtttag

SEQ ID NO: 897 - DNA, 2202 bp, Arabidopsis thaliana
tcttactcaatccgaagaatgggaactagatggaggagaatgaaactagctttgggtctaaatctctgcacgtacctcccaagaactctagaggaatcacccactcctttgaattctacagagagactatccgatgttgctctgctttctccacttaactggcctatgactccgacaccttcctctcacggtctgaaattgtccagaaacagctctaaatcttcaaagacatgttctatatgcttaaataagatgaaagaaggaggaggacatgctcttttcacagcagagtgctcgcattcgtttcattttcactgcattgcttcgaatgtgaaacatggaaaccaagtttgcccggtgtgccgtgcaaaatggaaggaaatcccaatgcagcacccaagttttgatcttccttatctctttgctcggtcttataacaatgatgcagctattagccttgtccaccgcttacctagatctcgtggagttatgaatcaaggacgaggtctggctcctgagccgtctatgtttgatgatgatgaacggttagagcagcaactcgtgttttctgggaagagctatagtgatgctttggagaacaatcatcctgtaagaatgatggacttgaagatatatcctgaggtttccgctgtaccacgagctgactcccgtgagaagtttgatgtattggtgcatcttagagctgctgccatggttactggaaatgctaactctctcaacaatcagatatctaggtatcctcgagctccagttgatcttgtcacggtgcttgacatcagtgggagcatggctggaactaaactggctctactcaaacgagcaatgggttttgtgattcagaaccttggttcaaatgataggctctcggttattgctttctcttctactgctcgtcgtcttttccctttgactaagatgtctgatgctggtaggcagcgagcccttcaagctgtaaactcagtggttgcaaatggcgggaccaatatcgctgaaggtcttaggaaaggtgtcaaggtgatggaagatcgaagagataagaatcccgttgctagcattatccttttgtctgatggacgagacacctataccatgaaccaagctgatccaaactacaagttgttacttccattgtctatgcacggttgtgaaagcaagcggtttcagatcccggttcattcttttggctttggatcagatcatgatgcttcactgatgcattctgtttctgaaacctctggggggactttctctttcattgagagtgaatctgtgatccaagatgctcttgctcagtgcattggtggacttttaagcgttgcagtgcaggagctacggttagaaatcgagggtatgtgctcagatgttcatctcagctcaataaaagccggaagttaccagagccttgttagtggtgatggtaggtctggatgtgttgatattggtgatctttacgctgatgaagagcgggatttcttgatatctgtcaacatccctcctcaaaaagatggaaacgagacaccacttctcaaaatgagatgtgtctacaaagatcttttgacaaaagaaattgtgacgcttcaaagtcatatgctcaagattcaaagaccagaaaccgttggtcaagaagttgttgtttccatcgaagtggacaggcaaagaaacagatttctagctgcggaggcaatggtaaaggcgagagctttagcagaaagagaagatttagccgcaggtgtcactgccatccagaatttcagagtggcgttggcagagacagtctcagcgaaatcgggtgatgggttttgtgtggctttggacagagagctaaaggaaatgcaagaaagaatggcgagtaggcatgtctacgaggtatcgggaagagcttacattctttctggacttagttcacactcatggcaaagagcaacatcaagaggagaatcaggagatggttcaagctttgtccaagcttattaccaaactccatcaatggttgagatgttacacagatctcaggctacatcgcatcatcatagactcatccagcctttgtttgcatctcaaccaaagccaaggtgaaaaaataagcaagattcaatgtaaaaatgtttcagctatttttgatctctctcgaaactttctggtctctctttgggcgtgaggaggagaaatgtgaatcgaagt

SEQ ID NO: 898 - DNA, 1066 bp, Arabidopsis thaliana
tcaaatcaatatgggatctttcgtgaaagaagaaacgtcgtcgttgatgacagattttttggagaagtgcggtggttatgcggtggtggatggagggtttgcgacggagctacagcgccacggagctgatatcaatgatccactttggagtgctaagtgccttattacttctcctcaccttgttacaaaggtgcacttggattaccttgaatctggagcaaatatcatcataacagcatcttaccaggcgacgatacaaggttttgtggcaaaaggtctatcggtgggagaagcagaaaatttacttagaaggagcgttgaaatcacgtacgaggcacgtgagattttctacaacagatgcaccaagggttcatgggatttcgcctacgctggaaaagcttcccggagaccaattcttgtcgcagcttccgttggtagctatggagcttatctcgctgacggctccgaatacagtgggatatatggagattctgtgagtaaggagacattaaaggatttccatagaagaagagttcaaatcttagcaaaatctggagccgacctaatagcattcgagactattccaaataagctcgaagcagaggcttatgcggatcttcttgaggaggaagatatcgatattccggcatggttctcgttcacttccaaggacggagtcagtgtgccacgaggagattcagttgtagaatgtgcgaaagtggcagattcatgcaagaacgtggtggccattggaatcaattgtactgcaccaagatacattcatgctttaattatctccttgcgccagatgacacgcaaaccaatcgttgtatacccaaacagcggggaagtctacgacggtctgaacaagaaatggattaagtcagagggagagtcagaggaggattttgtgtcgtacgtgagtaaatggagagatgcaggagcttctctgtttggaggatgttgtcggactactccaaacaccatcagagccattgctaaagttctctccgacgaaccttctgcagcatcaaaacccaaattcgggcaatagacttgtcaataa

SEQ ID NO: 899 - DNA, 875 bp, Arabidopsis thaliana
ttcgttaaattatgtctttgaggtcagaatcttcaacggcagagaagataacagaggatccggtgacgtataagacagcacaaagcagcgtgacgtgcatctaccaagcacatatggttggattctggagaaacgttagggttctatggtctaaaaatctcatgaaccattccttaaccgtgatggtcactagcgtacaaggcgatatgaattactgttgcaaggttgatcttaagccatggcacttttggtacaagaaaggttacaaatcgtttgaggtcgaaggaaaccaagtagatgtctattgggattttaggtctgcgaaattcaacggcgggcctgagccgagctccgatttttacgtggcgcttgtatccgaggaagaggttgttttgttgttgggtgatcacaagaagaaagcttttaagaggactaaatctagaccttccttggttgacgctgccttgttctacaagaaagagaatgtgtttgggaagaagattttttcgactagggctaagttccatgataggaagagagagcatgagatcgtagtggagagctctaccggggcgaaagaaccagagatgtggattagcgtagatgggatcgttttggttcaggtgagaaatctgcagtggaaatttagagggaaccagactgttttggttgataaagaacctgttcaagtgttttgggatgtgtatgattggttgttcagcacccccggtacggggcacggcttgttcatctttaaaccggagagcggtgaaagcgaaacgagcaacgaaaccaagaattgcagtgcttcttcttcttcttcttcgtcggagttttgtctctttctttatgcttggaaattggagtaagtctaa

SEQ ID NO: 900 - DNA, 1211 bp, Arabidopsis thaliana
tccttcttgtgtgagaccgagaaaaaaagatgactaagaacagtaaccacgacgagaatgagttcatcagctttgaaccaaatcagaacacgaagatacgctttgaagatgctgatgaagacgaagttgctgaagggtctggtgttgccggcgaggaaactccccaagatgagtccatgttcgacgccggagagagcgccgacaccgctgaagtaactgatgataccaccagtgccgattactacttcgattcttactctcactttggaatccatgaagagatgttgaaggatgttgtgagaacaaagacttatcagaatgttatttatcagaacaagtttcttatcaaggacaaaattgttcttgatgttggagctggaaccggaattttgtctctgttctgtgccaaggcaggagctgctcatgtctacgctgttgagtgttctcaaatggctgacatggcaaaggagattgttaaagctaatggattttctgatgttattacggtattgaaagggaagattgaggagatagagcttcccactcctaaagtggatgtgattatatcggaatggatgggttactttttgttgtttgaaaatatgttggacagtgtcttgtatgctcgtgataaatggcttgttgaaggtggagttgtgctaccagacaaagcctctctgcatcttacagccatagaggattcagagtacaaagaagacaaaatcgaattttggaacagtgtgtatggttttgacatgtcatgtattaagaaaaaagctatgatggaaccacttgttgacacagtcgaccaaaaccaaatcgtcaccgatagtaggcttctaaagacgatggatatctcaaagatgtcctctggtgatgcttccttcacagctccctttaagcttgttgcacaacgcaatgactacatccacgcccttgtagcctactttgatgtatcgtttaccatgtgccacaagctgctgggcttctcaacaggaccgaaatcccgagctacacactggaaacaaacagttctgtatctagaagatgtgttaaccatatgtgagggtgagacaatcactggaactatgtccgtttctcctaacaagaagaatcctcgagacattgacataaagctaagctattctttgaatggccagcattgcaagatctcaaggacccaacactacaaaatgcgttaaagttcttag

SEQ ID NO: 901 - DNA, 1518 bp, Arabidopsis thaliana
aacgtgatcaatatggaagctctaatgcttatcttcacgttctgtttcatagttctctctctcatattcctcatcggaagaatcaagcgaaagctcaaccttcctccgagtcctgcatgggcgttaccagtgatcggtcacctccgtcttctcaagccaccactccaccgtgttttcctctccgtctctcaatctttaggcgacgctccgatcatctccctccgtctcggcaaccgactcctattcgttgtctcttcacactcaatcgccgaggaatgcttcacgaagaacgacgtcatactcgcgaaccgacaaaccaccatttctacaaaacacatctcatacggcaactccaccgtggtctctgcttcgtacagcgaacactggagaaatctccgccgcatcggcgccttagagattttctcggctcatagactcaatagcttttcctctattcgccgcgatgagatcaggaggcttataggccgtctcttacggaactcttcttacgggtttactaaggttgagatgaaatcaatgttttctgacttaacattcaacaacatcattagaatgctagccggaaagtgttactatggagacggtaaagaagatgacccggaggccaaacgcgtgcggacgcttatcgcagaggctatgagttcttctggtcctggaaacgctgctgattatataccgatcctgacttggatcacatattccgagacacggataaagaagctcgctggtaggcttgatgagttcttgcaaggattggtcgatgagaaacgagaaggaaaggagaagaaggagaacacgatggttgatcacttgctttgtctgcaagaaacccaaccagagtactacatggaccgcatcatcaaaggaaccatgctttctcttatagcaggggggactgatacaacagcggtaacattggaatgggcattgtcaagcttgttgaacaatcctgaggtgctgaacaaggccagagacgagatcgacagaatgatcggtgtagacaggcttttggaggaatcagacatcccaaatcttccttatctacagaacattgtatctgaaacgttacgtctgtaccctgcagcccctatgctgcttcctcacgtagcctcgaaagattgtaaagttgggggatacgatatgccgcgtgggacgatgctattgactaatgcatgggctatacacagggatcccctgctatgggatgatccaacgagcttcaagccagagaggttcgagaaagaaggagaggctaagaagctaatgccgttcgggctaggaagaagggcatgtcctggatccggtttggctcagcggctagtgaccttgagtctcgggtctttgattcaatgttttgaatgggagaggattggagaagaagaggtcgatatgactgaaggtccaggactcacaatgccgaaagctagaccgttggaagctatgtgcagagcacgtgactttgttggtaaaatcttacccgactcctcttgagtttag

SEQ ID NO: 902 - DNA, 1577 bp, Arabidopsis thaliana
caaagatgttttactatgtgattgtccttcctttagctctctttctcttggcttacaaattattcttcacctccaaaacgaagcgtttcaacctccctccctctccaccttactctctcccaatcctaggccaccacaacctcctcaagccgccggtccaccgtctcttccaccgcctctccaaaacacacggcccaatcttctccctccaatttggctcccgccgtgccgtcgtaatctcctcctcctcactcgcaacacaatgcttcacaggccaaaacgacatcattctctcaaaccggccttgtttcctaaccgctaaatacgtcgcttacaactacacaaccgtaggaaccgcgccttatggcgaccactggcgtaacctccgccgcatttgctccctggaaatcctctcctcgaaccgtctcacaaacttcctccacatccgtaaagacgaaatccaccgcatgctcacgagactctcacgcgacgtcaacaaagagatcgagctcgagccgctcttgtccgatctaacgttcaacaacatagtaagaatggttacagggaagagatactacggcgacgaagtccataacgaagaagaggcaaatgttttcaagaaactcgtcgccgatatcaacgactgtagcggcgcgagacatcccggagattacttgcccttcatgaagatgttcggagggagctttgagaagaaagtgaaagctcttgcggaagccatggatgagatcttgcagcgtttgcttgaagaatgcaagagagataaagatggtaacactatggttaatcatttgctctctctgcaacaaaatgaaccagagtattacactgacgtcactatcaaaggcctaatgctgggcatgatgatcgccggaacagacacttccgctgtgacgctggagtgggcgatgtcgagcttgctaaatcatcccgaggctttggaaaaagcaaaactagagattgacgagaaaatcggacaagaacgtttgatcgatgaaccagacatcgcaaacttgccttaccttcaaaacatagtgtcggaaacattccgattatatccagcggcaccgcttctagtaccaagatcaccaacagaggatattaaagtcggaggatacgatgtgccacgtggcacaatggtgatggttaatgcgtgggctatacacagagatccagagctctggaacgaaccggagaagtttaaaccagagaggtttaatggcggagaaggtggaggaagaggagaagacgttcataagctgatgccgtttgggaatggacggagatcgtgtcccggcgccggactagggcagaagatcgtgacattagcgttaggttcgttgatccaatgctttgactggcaaaaagtcaacggcgaagcaatcgatatgacggagactccggggatggcaatgcgtaagaaaatacctctatctgctttgtgtcaatctcggcccattatgagtaagcttcaggcccatttaaaaggttaggtttgttttcttcttaaagttctttttagttttctgttttctatgcatggagatgtgagattttga

SEQ ID NO: 903 - DNA, 759 bp, Arabidopsis thaliana
gaattcctgcagcccagggctaacatgctccatctccttcttctctccgacgaagaacattccaccaccaatagcatgcccccttcctcctccgcctctagatccgcctccaatcacagctcctcttcctcctcctcctcctcctctctccacctctgcaagcactctccttccgcgactctcgacctcctcatcctaatcctcgtcctcttctccggcgctttcctcctctcctcttacttctcctatctcttccactccttttctctcctctcctctcacttcccttccctctcctccttgatcttctccgacgatgaagatctctcctcgatccctcccgcttcctacttcttcgccttcgccgtcttcttcgccgcttcaattgcgtttctcgacctttgttgtggacccagatcgaggaagtgtcggaatcccaagtgtaaaggtttgaagaaagcgatggagtttgatttgcaattgcagacggaggaatgtgttaaatctggagctactaaggagatcgatcgattgccatggaaaggaggtagtgagagcaatcctgattacgagtgtttgagggctgagcttagaaggatggctccgcctaatggtcgtgctgttttacttttccgatctagatgtggttgccctgttgctaagcttgaaggttggggtcctaaacgaggccggcgtcataaaaaatcgcaagcgaacttggctctgaagggaggggtcgaccatcgctgatcaggttga

SEQ ID NO: 904 - DNA, 471 bp, Arabidopsis thaliana
cacacaagactaacgatgttgctagggaagagacagagaccaccaataaagagaaccacgagtctatctgagattaagttcgatttgaatcaacctagcgaacaagaaccatccgatcatcagattcagcttgtgaacgttgatgaacatcgtcaagttcatcaaagattgttagatcaacggcttttagcgatggtctcaccaagaggtacacagagaagacactcaagtgattattctgaagattttctaagatcttgctctctttgtaaacgtcttcttgttcatggccgtgacatctatatgtatagaggagatagagcgttttgtagtttagagtgcaggcaacaacaaattacagtggacgagaggaaggagaagaagaaaggttcggtgaggtccaccatcgtcgtcgccaccggaaccaccacaggagagagagtttccgccgccgtgtaggtctctttttaa

SEQ ID NO: 905 - DNA, 1799 bp, Arabidopsis thaliana
gttttgagatatgggaggaccagcttacgattgtctgaccaaccctttaggagccgtccgattctccttcgtaaatgctctgtcttcaggctacgatccggcttcgtctgtcggaaaagactggggtgtcgttgatttgttccgtcactacttctccgacgaatctgctatctcccaggttccaattcttgattcgtcaagtattaagtgggtgcaacccaagactcttgttcggtttcgtggaatgatacaggacatgcttgggaatgaattctatgctggtgcttacaaggatgattcaacatggagaacaaacaagtacagtgatgtttcacagtttcctgagggttcttccactgaaattcaagtttgggagcgtcgcttgctttactgtgttccagttccgggaaaaaaccagtggactgaatgttcttcacaagagctaaaaaaccggtttttggatctaactggccaaaacagggaaaagcgtgtgagggtggatgaagaaatgactgattccatggactccagtactttagaagctgggcgtaatggttctccttttaagaaaatgaaagtgggggaagctacttcatcagcttcagaatctcaggttccacaaacttctggtattccgcctgctacaagtgcagattctctgccttgtcttgtcaagatctatgattctccagagtcagatttgaagctaaatgatgtggttgaatttcttggagtgttgaccttcgatccaattgttatgatggatacagatacacttgatgaaaactctgatgctctttctgaagctgaatctgttcagatgccctctggaaaggtcccacgcctccattgtcttatccatagaaagcttgaaacacagcatttcctgcatggttcttcgttattaccagagccaaaatccccccaaatattcaaagagataagagagagtttgatgaagtaccttaccggtctacttgggaatgatcacattgccgcacagttcctattattgcatctcctgtcaaaggtgcatggaagagtagataatgttgctgttgggaagctttctcttaatctcatacaccttaataaagaaagcatgtctatcttcggtacccagctcagtggtgccctcaaaagcctcctaccgttcacacaatctataccacttactattgagtatctgaacactgcctcgttcggtcccaagaaagactatggaatcaacagattgatgcctggagttctacaaattgctgatggtacgcacttgatattggatgaaacagagttgcaaccaggcaccttgaactctgttggagttgagaatgcaaatctgcttaaaaacctcttggaatgtcagaaggttgagtatgatttccaatattacaaaatggaaatggccactgatgttcaaatgctcatattctccgagggaaagtcgaacataatgcccgccgatttggttctacctcttcaaccttctcaagtgaattcattggaagtcatcacaccagaaacagctgaaacttggaggtgctacttagctacttgcaaatcattatcacactccattgggcaagagttgcaacaggtggtggagaatgatttggttgcagctagacaaacagatcgtagtttaggcagccaagacttgagcagattgttgacaatggctcgtatgatgtctgtgagttatggtgagactacgctttcactagagcactggcaaatggtgttggaactagaaagacttagaaaggagaggctcaagtaaaaccactaatctagaatac

SEQ ID NO: 906 - DNA, 1133 bp, Arabidopsis thaliana
ggactttaaacatgggtgttctaagcatgaagggaggagatggagaacacagttatgctaataattccgagggacagaaacgtcttgcttctgatgcaaaaccggtggtggtagaaaccgtaaaagaaatgatagtgaaaacagattttcctggttgtataaaagtggccgacttaggatgttcttccggggaaaacacgttattggtcatgtccgaaatagtcaacacgatcattacatcataccaacaaaaaggcaaaaacttaccagagatcaattgttgtttgaacgatctcccagacaacgatttcaacactactttcaagttggtccctgccttccacaagttgctgaagatggatgttaaagggaaatgcttcatctcaggagtcccaggctcattctactcaagacttttccctagcaagtctctccattttgttcattcatctctttgtctacattggctttccaaagttcctgatgggcttgaagataacaagaagaatgtgtaccttagaagtccatgccctccaaatgtgtacaagagttatttgactcagttcaagaatgatttctctttgtttctgagactgcgtgcggatgagactgtgccaaatggacgtatggctcttactttcgtgggcagaaaatctttggatcctttatctaaagattgtttccaaaattggtcgtcgatatctgattccctcctcgacttggtttctgagggtattgtgaaggaatcggatgtagattcttttaacttgccattctacaatcctgacgagagtgaggtgagggaagttatcgaaagcgagggctcgttcaaaatcagcaattttgagacaatctttggtcttctcttttcatacaaaactggtcgtactgaagtgaaagatgatgatgataatttggaccaatcatgtcgatttgaagtcattcgaaagagggcaagcatcataagatccattactgaaccaatgcttggtgctcattttggagacgccattatggatcgtctgttcgagaggtatacataccatcttgccgagcgttacgatactttgcgcaacaaaccaactgttcagttcttcgtttccttgacaaggaagtaacaaacctatgagtag

SEQ ID NO: 907 - DNA, 239 bp, Arabidopsis thaliana
ttaatcgttagaagatgagccagtacgatcacaaccagtctgcaggagctaacccaccgccaccgatgtctacctgtacatcaccaccaccgccgattggttacccgactaaccaaccgagtcatggttcggtagctcagggtaaagtggaaaccaagtctaagggtgacggattcttcaaaggctgtcttgcggccatgtgttgctgttgtgccctggacatttgcttctaagcctga

SEQ ID NO: 908 - DNA, 981 bp, Oryza sativa
gaggagatggcgagcaacggcggcgaggagaagagccgggtggcggcggggtacggcgggggagggtacgggtacggcgggtacgaggggcgggacgacaggaagtggtggccgtggctcgtgcccaccgtgattgtcgcctgcatcgcggtgttcatcgtcgagatgtacgtcaacaactgccccaagcacggcagcgcgctcggcggctgcgtcgccggcttcctccgccgcttctccttccagccgctccgcgagaacccgctcctcggcccgtcttccgccactttgcagaaaatgggagctcttgactggaacaaagttgttcatcagcaccaaggatggcgtctcattagctgtatctggctccatgctggcctaatccatttggttgtgaacatgctgagtttactgtttattggaatccgccttgaacagcaatttgggttcgttcgcattggtgccatatacctgctatctggttttggcgggagtgtgttgtctgcgcttttccttcgtaataactacatctctgttggagcctctggagctttatttggactgcttggatcaatgctttctgagcttattatgaactggactatttattccaacaaggcagcagccataataactcttctatttataatcgcaatcaacttggctattgggatactacctcatgccgataactttgctcatatcggtggatttgtgacgggcttccttttgggatttgttttgttggcaaggccacagtttggttggatggaacgacatgagttgccccaaactaatcagcctcccaaatacaaagcataccaatatgttttgtgggttgtggcattcgttttgctgcttgtcgggtttgtggtttcactagtgatgctcttcaagggtaagaatggaaatgacggatgccactggtgccactacctgaactgcgtacccacatcgaagtggaagtgcaatacctaataa

SEQ ID NO: 909 - DNA, 1328 bp, Oryza sativa
caccagaaacaaagagagagtgatgctagcttttttcacgtgttgttcgccgaaagtttgttgtcgtctggttagagagcctactcgacgagtgcctataaaatgaacgtttcgaaacgaaagaagcagactcaactagagcaaataactcatatccgtagagcaaataactcatattcctagagtttatcattggtgtaagcttcaataggttagtgcgcttggcgaattcacaggccctatcttgtggtatgaactgggtacgcgatgatttgcactgcgtattgggggcttaccataagataatgccatgaatttgtcaagcgttcaaacccactgaaatgttgtgtgaaggtaaatatttcaaagtgttcatgaagaaaaggcaggtaaatatttcgttacttccccgtgacatgctaagccagaaacaatctcgctgcatgtgatatgctcagccagaaacagaaacaaaagagaaaaagagagtgattcttcccagcttttttcatgtgttgtctggttagagcctactcgttgagtgcctataaaaggaacgttacgaacgaaagaagcagactcaagaatagtatatcattggtgtaagcttcaataggttagtgtactttgcgaattcacaggccctatattgtggtatgaactgagtacgcgatgatttatggtgcatattgggggcttaccataagataatgccatgaattcgcaaagtgttcaaacccactaaagtgttatgtaaaggtaaatatttgtaagtattcgggatggaaaggcaggtaaatatttaaagtttattaatttagaaatgtagctgagacattagaaagttttaacacacaacattacatattagtttgaatgagcaaaatataaaagcgttctactcattagcctcatcatcgaaatttcgtgacgtgttagtgtcctttttctttccctttcttctagcaccggttggaggtctgcatcctgacaaagataatcttttaggtgaatgtcgctcgcggacagacctacggaccacctcaacaccgctgagatcaacgtggccgtagttttgggtcgctgagttactggtggcgattcatcaagctgtgacggtcctatctcgtgttgtgctgttgacgaccccccaccgtagctatatggttctccgtaggactatgtgctgccagcatatcccatcatttgttcagggttgtacattcctacaaaacattgaatgcaaagttgtagcgtacacacataatggaaataaaatattttgtagtaaattataatttgtacctattgtttgtggttgcatgata

SEQ ID NO: 910 - DNA, 1772 bp, Oryza sativa
aagtccaagtgaccaaccatcatcaatcatcgctaagcccacctcggagatctcgagttcgatcgtcgtcgtcgtagctgtagaggtagttaattatctcgttttagatgagctcactgacggcggcgcagttccggtcgctgtttgagatggcaggaggggaggatatctcgtttctgtttggtgatgatgaggcggcggcggtggcggcgccggtggagttgcaggggaagagggggtgggaggaggtggatcaaggggaggggtctggggcggtggcggcgaagaggcagcggtcgccgacgagctcgagggagaatagtagcgggagtaatgagggtgggcaggaggaggtgtctgaggcggcggcggccatggcggcggcggtggggaggggtggggggaggaggctgtgggtgaaggagagggactcggagtggtgggacatggtgagtagcccggattacccggactcggagttcaggaaggcgttccgcatgtccaaggccacgttcgaggtggtctgcgacgagctcgccgccgccgtcgccaaggaggacaccatgctccgcgccgccatcccggtgcgcaagcgcgtcgccgtctgcgtctggcgcctcgccacgggggagcccctgaggctggtgtccaagcgcttcggcctcgggatctccacctgccacaagctcgtgctcgaggtctgcgccgcgctcaaggccatggtgatgcccaaggtggtgcgctggcccgaggccggcgacgcggcggccatcgccgcgcacttcgaggccatctccgggatctccggcgtcgtcggcgcgatctacaccacccacatccccatcatcgcgcccaagtccaacgtcgcctcctactacaaccgccgccacacggagcgcaaccagaagacctcctactccatgaccgtccagtgcgtcgtcgactccaccggcgccttcaccgacgtctgcatcggctggccggggtccaactccgacgaggaggtgctcgagaagtcggcgctgtacctgcaccgcggcgttcccggcctgatccagggccagtgggtggtcggcggcgggagcttcccgctcatggactggatgctcgtgccctacacccaccagaacctgacgtgggcgcagcacatgctcaacgagaaggtcgccgccgtgcgcggcgtggcgcgcgacgcgttcgagcgcctcaagcgccggtggggctgcctccagaagcgcaccgaggtgaagctgctcgacctccccaccgtgctcggcgcctgctgcgtcctccacaacatctgcgagcgcagcggcgacgccgtcgtcgacgccgacgactgcgccttcgacctcttcgacgacgacatggtcgccgagaacgccgtccgctcctccgccgccgcgcaggcccgcgacgccatcgcccacaacctcctccacagcggcggcggcgcatccttcttctgatcaagcatcatcgccgttcttggtccgatcaacagcgataccaaacaaaccaacaaaaataaaaaagaaaaacaagattcagtttttaggtgtataggaggagcttctccattttttgtcggaaatggagcagtgaacagtttttcgctttatcgtcaggagggacaggaaagttcagagtcctagtagtctcaaagtaacattagtttcttggttggattttcgattgatttggttcttttagatcttgagagattgtttttcatggggttgtaattaattgcctgcataatcttgtatccc

SEQ ID NO: 911 - DNA, 532 bp, Zea mays
tacctgcctttctctcgtccctggcggcggcggcaggatggcggcttctactgcgaggacggtgaaggatgtgaacccccacgagtttgtcaaggcctactccgcccatctcaaacgctccggcaagatggagcttcctgagtgggttgacattgtgaagactgcgaggttcaaggagctccctccttatgaccctgactggtactacatcagggctgcatctgtagcaaggaagatctacttgagacaaggcattggtgttggtggcttccagaagatttatggtggccgccagaggaatggctcacgcccacctcacttctgcaagagcagtggtgccatttcacgcaacatcctccagcagctgcaggagatgggcatcattgatgtcgatcccaagggtggacggcgcatcacctcccagggaaggcgtgatctggaccaggtggctggaagggttgctgttgaagcttgagcaatctcatatttggtttctatgatgtcatgtttgattgttgagatggctacatag

SEQ ID NO: 912 - DNA, 1777 bp, Arabidopsis thaliana
ccacaaaattcgtcaaagctctgaaacaaataaacattttttaatttctccctttttaatggaaatctcttctttcccatttccatacctacaagacgacgagtgttcccatttccttggtctatttcaagacatggactcttctccttctactttcggattagaaggttttaatagcaacgacaataatactaatcaaaagaaacgcccaagaaaagacgacgaaggcggtggtggtggcggcggaggaacagaagttctaggagctgttaatggtaataataaggctgcttttggagatatactcgcgacgcttctgttgttagacgaggaagctaaacagcaacaagaacagtgggattttgaatttattaaagagaagtctttacttgaagctaatcataagaagaaagtgaaaacaatggatggttattacaatcaaatgcaagatcattactctgcagctggtgaaaccgatggttcgcgttcaaaacgcgcacggaaaaccgcggttgcggctgtggtttccgcggtagcttccggggcggacacaaccggtttagctgctccggttccgaccgcggatatcgctagcggttccgggtcaggaccgagtcataggaggttatgggttaaagaacgaaccacggactggtgggacagagtaagccggcctgattttccagaagacgagtttcggcgagagttccgtatgagcaaatcgacgtttaacctaatatgcgaggagctagatacgacggtgacgaagaaaaacacgatgttaagagacgcgattccagctccaaaacgcgtaggcgtttgcgtttggcgtttggcgacaggagctccgcttcgccacgtgtcggagcgtttcggtctgggaatctcaacttgccacaaactagtcatcgaagtctgccgcgcgatctacgacgttctcatgcccaagtatctcctctggccgtcggattcagagataaactcaacgaaagccaaattcgaatcggtccacaaaataccaaacgtcgtcggatcaatctacaccacacatattccgatcatcgctccgaaagtccacgtggcggcgtattttaacaagagacacacggagaggaatcagaagacgtcgtactcgataacagtacaaggagtggtcaacgccgacgggatcttcaccgacgtttgtatcggaaacccaggatctctcaccgacgatcagatcctggagaaatcttcgctttcacggcaaagagcggcgcgtgggatgttacgtgacagctggatagttggaaactctgggtttccgttgactgattatcttcttgtaccgtacacgagacagaatctgacgtggacgcagcacgcgtttaacgagagtatcggagagattcaggggattgcgacggctgcgtttgagaggctcaaaggacggtgggcttgtttgcagaaacggacggaggtgaagcttcaggatctgccgtacgtgcttggagcttgttgtgtgttgcataacatttgtgagatgaggaaggaggagatgttgccggagttgaagtttgaggtttttgatgatgtggcggtgccggagaataatatccgatctgctagtgcggttaatacgagggatcatatctctcacaatctcttgcatcgtggacttgccgggacaagaactctataggctctgtttttcaccttttcttattttgaaactgattttttattgcaaattctttttccaaattaggaataaaaacattttagggattggttggat

SEQ ID NO: 913 - DNA, 725 bp, Arabidopsis thaliana
tccttgtgattcattattttgcctagttttacttttcaaatagacttctaacaaaagttatgactgaaaaccaattatatagctttataaccatgaagagttcattgtctaaatgcaaacagtcttcttctttgtctttccctttgtttggtctgatcaacttcttcctcatcggttttttcagatgggtttcttttgctcagttatttttctctaggttctggcctcttgttcaacaccagcaatgtgtttccgagaagaagagcaaagatcttgagttccaaacttcgatcaaacacgaagaatatcgtgatgatgatgatgatggtctttgcagagaagatgtagggatggttatgaaaagcttagggctttccactgaccaagaaaacgagggacttcaaaaacagtacagttccaaggaggtttcgaatctgttcgaagagaaagagccaagcttagaggaagtgaagcaagcttttgatgtctttgatgaaaacagagatgggtttatcgatcctatagatttgcagagagttttgacaatccttggcttaaagcaaggatctaaccttgagaactgcaggagaatgatcagatcattcgatggaagtaaagacggaagaatcgatttctatggatttgtgaaattcatggagaacaacttctgctgaaatcgtatttccttaaagtatcaatttctgcacttcttttcttcttgctaa

SEQ ID NO: 914 - DNA, 1576 bp, Arabidopsis thaliana
gaaactggatctgggtttatccgtttttactcgtctgagaagagaaaaaaggatgaatccttatgatgcgaaagacagaagatggattctctctatgttcttcttcgtcgttttgttctgcaacaacgtttcgacttcgtcttcttcatctgaagttatcacgattaagccaagacatttatccttgctaaagagtgctttacaacggtcaagtggagaacagtctgatctatggaggccattgactgatcaaggatggagtccttgtattgatttgggaaattctccttcattaccggataaaaccgcgggatatgttcaggtatttcttgatggaggacttaaccagcaacgaatgggaatatgtgatgctgttgcagttgcgaagattttaaacgcaacactcgtgatcccttatcttgaagtgaatcctgtgtggcaagattcaagttcttttgttgatatttttgatgtcgatcattttatcgattctttaaaagatgacataagggtggttagagaactacctgatgaatactcttggagtacaagagagtattacggtacagcagtacgtgaaacacgagtgaaaaccgcgcctgttcatgcctctgcgaattggtatattgagaacgtctcaccagttctacaaagttatgggattgctgccatttctccattctctcaccggctatcattcgaccacttacctgctgagatccaacgactaagatgcaaagtgaatttccaagctttacgttttgtccctcacattacatcactcggtgatgctcttgtcagccgccttagaaacccgtcatggagaagcaataaggaacagaaaaatgttgatcatttaggagacatgaccaacccacacagaagacaagaacccgggaagtttgctgtgcttcatcttcgcttcgacaaggacatggctgcgcattcagcgtgtgattttggcggaggcaaagccgagaaactctccttggcgaaatacagacaaatgatttggcaaggaagagtgttgaattctcaattcactgatgaagagttaagaagtcaaggacggtgtcctctaacaccagaagaaatgggacttcttttagctgctttcggattcgataacaatactcgtctctatcttgcatcccacaaggtgtatggaggagaagctagaatctcaacattaagacaagtattcccaagaatggaagacaaaagaagtcttgcatcttctgaagaacgagctcgaatcaagggcaaagcttctttattagctgcacttgactactacgttagtatgcacagcgacattttcatctccgcatcacctggaaacatgcacaacgctcttgttggtcatcgaacattcgagaatctcaagacgatcagaccaaacatggcgttaataggacagcttttcctcaacaaaagcatcacttgggtagattttcagcaagcgcttggtgaaggacatgtgaatagacaaggacagatccggttaaggaaaccaaaacagtcgatttatacttatcctgctcctgattgtatgtgccatgtttgattagtttag

SEQ ID NO: 915 - DNA, 4712 bp, Arabidopsis thaliana
agagttaagtcaatcaccaaaccatgatgaagaagaagaaacagagcagatcccagtcttcttctaccaagaaaacttttgaaccatcctcagattcttcaccttcacctaggctcctctccattatccgttctaagttggcaagtagtaaagacttgaagcatatgttcagaggtatgaggagtagaaccgtgcccggattatcttctcaatctagaatcgtgagatgtcctaagtgccacaaacttctccaggaacctttagatgctacttcttacaaatgtggtggatgcgactcgattcttcatgcaaaacgttgggaacctgacggcaatgatcacacaaacactattcctgaggctctcctttcttctcaaaaccgtagtttaagtgctgaggtagaatctccagaagatggtagtagaactccaatgagaactactcaccgggagtacaattcaaggccatcgacttctgttgaaagaggttatcatccagaaactgtttacaagcctgagacatctgatatccgcagagaatggatgagaaggactgatgacttcagtgagaccggtgattctgatgtgtttacttcagaaagaagctctccatataacacacgcagcaatgctgcgcaatgggcacaacatgagggaagatacgcagatccacctcgggttcctttctatccagcaagtccttccccttcttctgcatatgaatatggctacagtagtccttttcacgggtcttacgtttctgcatcagagcagtcttattatcatcaacaaccaaaccaattcgagcagtatagcagagaaggctggtttcaagaatcttctgttgcttcacctactcgttttccgggtgagacatctgatggaaagtactatcacaggtcttctcagtctcagctacatgatcttcagtatcataatctttatgaaccaagtagatctgaaaccccgcatcactctgtgtactctgagcgtagttatgtaccagctgctgcgccacaccgctctacatactctgagcattctgtagggatttctaagagtgacacaagtagtgaaaagagcattctaaggaacaaaaaacggtatgtcagggaaaggaatccggtagtgaagcgccatattctcccttcagccggcggtgcaccttttgcaacttgttcctattgcttggaacttctacagcttcctcaagtgtctccccaaggaaaacgtcaaagatatcaagtgagatgtggcagttgttccggtgtacttaagttctctattcgagagaaagcagatactgtcctggattcacctagctttgtggattatggcatggattttgcagatgagactgttactaatcaccaggattcagcatcagaaggtcatgaagagattaatcctgatggaagtcatctgacgtgtttagacgacgattctggagaaacaatctgcaaaagtaacgatgctgttatattgagtcaaaaaattctagaaacatttgaggataaagggattaaagaagacataaggaatatatccaccaaatttttagatttgaaattggaggcattacagcctcatctaaaacctatggggaaccgcagattaagcgagcaacaacctacatcaagtgagactattggagagacttccaagattcatctagagcaatctcaggaagctcattcagaaaagtcaaccgagatggataataacatttgtgatatagaagagcctgaatatgagaagaacgaaattattaagccagaagaaattgtaggagaaggatcaggtgagtccttggaagttccagtaaaccagaacgaaaggatgagtgaatcaagtgaagaagatgagagagttgcagagagatcggtatctcatagtgaggaacttctatacaagaaagaatacgtcagtgaaacacgtgtacagtctgagaataccggagacacttacgagtttgaatgggaggagactcaagaaactgaagaatatgaaggtgaaagtacattagaagagatcggagacaaaccgcagttgcatttggataaatctaggtacactcgagattctatatgtgacagcagcttaagctatggtgaaccatttgaggatacatcagtcaaggaagatacggagcacatatcaaacacaatttcagatgcgaagtcagctacaacacattctcccttgaactctttggtgaatgagaatcagaggtttataggacatcttgaccaatcaggcgaggctacagtaacaatatccaggatccaggagcactccaagtatgaatatgagaatttaagcgaaagacaagagttggaaatgaccattagtgacagagtcacgtgtaagttagaggagtctagatacgagacaaatgaaactcttgagccgagcaaggtgggcgaagatggatctcttgtttctttcgagaaggtgagcgaggcattcgaaacaatcatagaaggcaagacaggtgaagagagactggtatctcatcaaatggattctccaaacgagaatgtagaaaattcttatggaacattagaaccggtttatctagaagaaagcgggtttgcaggtgaaagaacatgggaagggacaatagaagatagagcggggttacatttggaggaatatgaaagcaactatgagaattacagcagaccatttgaatggacttcagaaacagctccaacatttcgcatgcatgattatgagctagggacaatacttgaaccagacgagtatgctgacggaagatcagaatcaagttcacggggctccttcaatgacgatggaggttcagaagagagggtcgtttttcatgagtctcaagttgctatacctgagcagtcccactatgagtatgagaactcaagcaaaagacaagagttgagtgacaccgtttttgacatagcaaggtctgaattacaagagtatagatatgagagaaatgaaacacttgagccaagtaagatggttggagatggatctgttgttcctgttgagaaggcgggtgaaactttcataagcaaaaagaatgaagacagctcggtatctcatcaaatggagtctcaaaatgaagatatggaaaattcctacggaacaaaagaaccggtttatccggaaggaagcagatgtgaaagtgaaaattcatgggcagagacaatgggagatggagcggggttgaagttagaggaatataatagcaatccatttgaatggacttctgaaaaagctgcagcatttcatctgcatgagtatgaacgatggacagtgcctgaaccagaagaggatgctaatgaaagatcaataaccagttcacgggattcctttaatgaccatgaaaatttaaaagggatagctgtgtctcatgaggaggagccctggctagtggatgagaacagaacggaagctctaaaagttggtgtaatggtggaagatgaaccatcgctgcacctgacgaaatttgaaaacgaaacaatgaaattggaagagacacttgaatggacttcagaaagagctccaacatttcgtctacctgagtatgagctaggggaaatgcttgaatcagacaacgacgttgatgaaagatcagaatatagttcaaagggttccttcaatgatcatgaaattccaagagagttgttaaatgaggaggatccccagctggtgattgatggcagaaccgaagctgtacaagtaggcgaaatggcaaaagatacagtatcactgcacttggaggaatgcggaaatgaatcaatgaaactggatgagacatttgaatggacgtcagggagaactttaacgtttcgtcgccatgggtatgaggtagagacaaagcttgaagcagacgaggatgctgatggaagatcagaatctagttcaaggggttccttcaatgatcgtggaagttcaaaagagagagctgtacttcacgaggatgggtcttggctggtggatgattatgaaaccaaagcgctaaaagtaggcgtaatggcagaagatggatcatcgctgcagttggagaaaggcgaaaatggaaaaatggatttggacgagacacttgaaccaagggatgatatattcaggctcagtcttgatgacacacttgagcaagaaaggatgacgtttcatttaaagatgtctcaagataagcaagaaagtctaaggcagacctttaaacaaggtgatgctgaaaaagattcagacgtattttcagaaggccatgaatttccaagtaaaatggcagaactagatagtgacactgaagaggagatagtggaagaacaattagaacatttgcagaaagagaatgagaagttaagtctaacctttgaacaacatgatcacatctacagcacaacggagccttctgaaattgtgggtttgcgtcatgcgttataccaaacgcaaaattcacctctacgatcacctctcacttcaccaattcatactcccattggttctccgctgcattacctgatggcttcacaaatacgttctccaatagcttcaacaatgcatagtcacatagtttcaccgcttcgttctcccatcaactcctctggatcactctctgatgtattgttcttcagcaagaaaacttgatggcacgaaaacagataagcattgttccaagctttccccacatacttgaagactttacctgcgatacaaaaacagtgtgta

SEQ ID NO: 916 - DNA, 364 bp, Ricinus communis
ccaacactatatcatggctactatcactgttaagttgattagctttcttgttttatgcttggtggttgctatgcccatgaccaccgaagccataacatgtggtcaagtcgttagcggcctgagctcatgcctttcctacctaaggagtggaggagcagtgccaccagcatgctgcaatggggttaggggtctcaatagcgctgctaaaaccacggccgatcgccaacaggtttgcgtgtgcctgaaatctgcagctgccggaatcaaccttagtaatgcatctagcctccctggaaaatgtaaagttaacattccttacaagatcagcccatccactgactgcaagagcatcaagtgaggttag

SEQ ID NO: 917 - DNA, 581 bp, Arabidopsis thaliana
acacccctcaaagaaatataacataatcaatcataggaaatatacttcgcataatgacgataatgatcaagtttctcctgttagctctgctcgtgatctctccgatttgcgccgagaaggacctgatgaaagaggaatgccataatgcacaagttccgaccatttgcatgcaatgtcttgaatccgacccaacctccgttcatgcagaccgtgttggcatcgccgagatcatcatacactgtctcgactctcgtctcgatatcatcaccaataacattacaaatatattgtcactgggaggaggaacgaaagaagtgagaaaaatcttggaggattgcagaaatgacacgtcgacggtggcacctaaactactgtcggaagccaaaacaggtctgaaaaccggtgattacgacaaagccgccaaatcgatagagtatgctagcattcctcatagctgtggattaaagcaaccaagtgtcgagtttgagtttcttcaactgtttagtcaaatcagtatctatactcaactctctgatgctgccatgagaatcattgatcgcttctaattactccacctttag

SEQ ID NO: 918 - DNA, 549 bp, Arabidopsis thaliana
gaaagagagaaaatggagaatatgttaggtcttctaagacttcatgtgattagaggtgttaatcttgccatcagagattctcaaagcagtgatccttatgtcattgtccgtatgggaaaacagaagctacgaacccgtgtgatgaaaaagaatttgaatacagaatggaacgaagacttgacactttctgttactgatccaactcttcctgtcaagatcatggtgtacgatagggacaggttctcaagggatgataagatgggagatgcgatttttcacattgatccgttccttgaagccatcagaatccaaaaccaactaggaggactacctgaggggactgtaataatgaagatacaggcaagcagacaaaactgcttgtcagaagagagcaagattgtatggcacaaaggaaagattgtccagaacatgttccttaagcttcagaatgttgaacgaggggagatagagctgcagcttgagtggatcgatgtctccggcgccttgactgatgatgcggaggatgttgctttctagatcgactcttag

SEQ ID NO: 919 - DNA, 652 bp, Arabidopsis thaliana
tgataagaatgctcctgactgggggtttacagaaatgatcagcctcactgaacttcatgcggaagagggacttctgaggaacggagaactcaccgttgttgccaaggtagaggttcttgaagttgtaggaaaattagatgtatcagaggaatcttcaccagtaattgaaaccatagatgtcaatggatttcaagttcttccttcacaggtagaatatgcgaagtctttatttgaaagacatctagatattgcatcaaaattccgtccaaagaatccatacctaaagacggcgtacatgaatgtcctcttgagtttaacccaaacgatatgtcaatctcctcaagaactctccaatgatgatctctctgatgcaggcgctgcattggcatatttgagagaagcagggtttgagttggattggttggagaagaaacttaatgaagtaaaggaaaagaaaaagaaagaagaggcttgtttggccgagatacaagacatggacgaacatgttaagccattgaagaagaagtacttagacctggaagctcagatagataagaagaaggcagagttgctagctgcaagagctcctctctccttgaacgatgacaatgttgtctgattatttttgagttcttgggcacttggattttag

SEQ ID NO: 920 - DNA, 1569 bp, Arabidopsis thaliana
cgaagtaagaaaagaaaatggagattttgacgagcatagctattacagtagcaacaacgatcttcatcgttttgtgtttcactatctatcttatgatcagaatctttaccgggaaatcaagaaacgacaagagatatgctccagtgcatgccacggtctttgatcttctcttccacagcgacgagttatacgattacgagacagagatcgcgagagagaagccgacttacaggtttttgagtccaggacagagcgagatattaactgcagatcctcgtaacgtggagcatattctcaagacaagattcgataactatagtaaaggacacagtagtagagagaatatggcggatcttctaggacatgggatctttgctgttgatggagagaaatggagacaacagaggaagctttcgagctttgagttctctactagagttttaagagattttagctgctctgtttttaggagaaatgcatctaagcttgttggttttgtctcggagtttgctctctctggaaaagcttttgatgctcaagatttgttgatgagatgtacactggactccatctttaaagttgggtttggtgtggagttaaaatgtttggatgggtttagcaaagaagggcaagagtttatggaagcttttgatgaaggtaacgttgcaactagttccagattcatcgatcctctttggaagctgaaatggtttttcaacattggatcacaatctaagctcaagaagagcattgctactatagataaatttgtctatagtctcattaccactaaaaggaaagagcttgctaaggaacagaacactgttgttagagaggacatactatcgagattcctagtggagagtgagaaagatccggagaacatgaatgataagtacctgagggatataattctgaacttcatgattgctggtaaggacacaaccgctgcactactctcttggttcttgtacatgctctgcaaaaacccacttgttcaggagaaaatcgtacaagaaatcagagatgtgacatttagtcacgagaaaacgaccgatgtaaatggtttcgttgaaagtattaacgaagaggctcttgatgagatgcactacctccatgcagccttgtctgagaccttgaggctctaccctcctgtgcctgtggacatgaggtgtgcagaaaatgatgacgttcttccagatggacatagagtgagcaaaggggataatatctactacatagcctatgcaatgggtaggatgacttacatttggggtcaagatgctgaagaattcaagccagagagatggctcaaggacggcttattccaacccgaatcaccattcaaattcataagctttcatgctggtccaagaatctgtcttggcaaggatttcgcataccggcagatgaagatagtatcaatggcacttcttcacttctttcgcttcaaaatggctgatgagaacagcaaggtgtattacaagagaatgcttactcttcatgtcgatggaggactccatctctgtgcaatcccgaggacaagcacttgagtatgatctagaatac

SEQ ID NO: 921 - DNA, 274 bp, Arabidopsis thaliana
caacgagcaagagaaaatggccatcacaaagacttcagtgactcttttacttttaataataatggctgcttcgttgtctaatttcagcgtcttggcttcagagatcaaacctacaggaagagttgataatcaatgcaaggagatgtgttcggcaacgtttggggacggtaaatgtgccgcagactgtaggaaggctggtttctcatccggacgatgtcttacttcttctcctttcggaaataaatgttgttgcacctagtgatagctagaacca

SEQ ID NO: 922 - DNA, 2094 bp, Arabidopsis thaliana
cgagtacaatggaggtttcgcaagatggatcggaaagagataaaactcctcctccttcctcttcttcttcttcttcctctcccattcctgtcgtcaccaatttctggaaagaatttgatttggagaaggagaaaagcctgcttgacgagcaagggcttagaatagctgaaaatcaagaaaacagccaaaagaatcgccgaaagcttgcagagagcacacgagacttcaagaaagcttcgcctgagaacaaacttagtatgtttaattccctcctcaagggatatcaagaagaagtagataatattaccaagagggccaagtttggggagaatgctttcctaaatatctatcagaaactctatgaagcacctgatccgtttcctgctcttgcttctattgctgagcaagatcgtaaattatctgaagtggaatctgaaaatcgaaagatgaaagttgaacttgaggagtttaggacagaagcgactcatcttaaaaatcagcaggccacaataagaaggcttgaagaacggaaccgccagcttgagcaacagatggaagaaaaaatcaaagaagttgttgagatcaagcaacgaaatctggctgaggaaaaccagaaaacgatggagcttttaaaggatagggagcaagctttgcaagatcagttaaggcaagcaaaagacagcgtctccactatgcaaaaattgcatgagttagcacagaaccaactttttgaactccgtgctcaatcagacgaagagaccgcggggaagcaatctgaagttagtctattgatggatgaagtggagcgtgctcagacccgactccttactcttgagagggaaaagggacatctgcgttctcagctgcaaacagctaatgaagatactgataacaagaaaagtgataatattgattcgaatagtatgctggagaactcgttaactgcaaaagagaagattatttcggagcttaatatggagattcacaatgttgagacagctttagctaatgagcgagaaagtcatgttgccgagataaagaaattgaattctttgctcaataaaaaggatactatcattgaagagatgaagaaagagcttcaagaaagaccatcagcaaaattagttgatgatttgcgcaaaaaagtgaaaattctgcaggctgtaggttacaattcaattgaggctgaagactgggatgctgctaccactggtgaagagatgagcaaaatggagtcgcttcttcttgataaaaacagaaaaatggaacatgaggtcactcagttaaaggttcaactttctgagaaagcttccttgcttgagaaggctgaagccaagggagaagaactgacagctaaggttaatgaacaacaaagactgatacaaaagttggaggatgatattttgaagggttacggttcaaaagagcgaaaaggtgctctatttgatgaatgggagttctcagaagcaggtgtggctgagcagtctgagcctatggatcagaaacatgttccatcagagcaagatcaaagctcaatgctaaaagttatctgcagccaaagagatcggttccgagcacgattacgggaaacagaagaggaaataaggcgattaaaagagaagataggttttctcacagacgaattggagaagaccaaagcagacaacgtcaaactctatgggaaaatccgttatgtccaagactataaccatgataaagttgtttcccgaggatcgaaaaagtatgtggaagatcttgaaagtggattcagctcggatgtcgaatcaaaatacaagaaaatttacgaagatgacatcaacccttttgcagcattctcgaaaaaggaaagagagcaacggatcaaagatttgggaatcagagatcggattacgctaagcagtgggcggttccttctaggaaacaaatacgcaaggacatttgctttcttctacacaataggattgcacgtccttgtcttcacttgtctctaccgtatgtctgcttacagttatctcagccatggagcagaggagactctaatgacagaagcaaccacaaaccttcctcacggtctttaagcttgatctagaatac

SEQ ID NO: 923 - DNA, 1403 bp, Arabidopsis thaliana
acagtcgtcgtcgtcaagcggcgtcagagaaagtctctctctgtgtctaactgaaaaaaatgcaatctggcggcgatttcagcaacggtttccacggagaccatcaccgcgagcttgaattggaagacaagcaaggccccagtctcagctcttttggccgagccaagaagcgcagtcacgccggagctcgtgaccctcgaggcggtctcgccaatgtgcttagggtttctgaccagcttggcgagcacaagtcattggagacttcggaatcttctcctccgccttgtactgacttcgacgttgcctattttcattcctatgctcacgttgggattcacgaagagatgatcaaggatcgggcaaggacagaaacttatagggaagccataatgcagcatcagagcttaatcgaaggcaaggtcgtggtggacgttggctgtggaactggcatcctttcaatcttctgtgctcaagcaggtgcaaaacgggtatatgctgtagatgcaagtgatattgctgtccaggcaaaggaagttgtgaaagccaacggtttatccgataaggtcattgtcttgcacgggagagtggaggatgttgaaatcgacgaggaggttgatgttataatttcagagtggatgggttacatgctcttgtatgagagcatgctgggaagtgttatcacagctagagatcgctggttgaagcctggaggtttaattctcccatcacatgcaacattatacatggcacctatttctcaccctgacagatacagtcacagtattgatttttggcgcaatgtttatggaattgatatgtctgcgatgatgcaattagctaaacagtgtgcttttgaagaacccagcgtggagtccatatcaggcgagaacgttctaacatggccagaagtggttaaacatatagactgtaaaactataaaaatccaagagctagactcggttactgcaagatataaattcaactcaatgatgagagctccaatgcatggttttgcattttggttcgacgttgaattcagcggaccggcctcttcacctgccaagaatactagtgaaaccagtattgctagtggttcttcgtcgataagtccttctggagaagtaaatcagaagaagcggactaatccgagtgatgcacttgtgttgtccacctctcccgagtctcctccaacgcattggcagcaaacgattgtatatttctatgaccctatagacgtagagcaagaccaagtcattgaaggttccgtgacactttctcaaagcaaagagaacaagagattcatgaacatccacctcgaatattcctcggccggccgttcctttgtaaaagagtcagtaatgcgttaaggaggcgattctctgacaattcatccttacctttag

SEQ ID NO: 924 - DNA, 1519 bp, Arabidopsis thaliana
accaaaatagatctaaaacatggaaaccaaaaccctaattttctcaattctcttcgttgttctctctctcatttacttaattggaaaactcaagcgaaagccaaatctacctccgagtccggcatggtcattaccggtgattggtcatctccgccttctcaaaccaccgattcatcgcacattcctctccctctctcaatccctaaacaatgctccgatcttctccctccgactcggtaaccgactcgttttcgtgaactcgtcacactcgatcgccgaggaatgtttcaccaaaaacgacgtcgtactggcgaacagaccaaacttcatcctcgctaaacacgttgcgtacgattacacaaccatgatcgcagcttcctacggtgaccactggcgtaacctccgccgcatcggctccgtcgagatattctccaatcaccgtctcaatagctttttgtctattcgtaaagacgagatccgacgacttgtgtttcgtctttctcggaacttttcacaagagtttgtgaaagtggatatgaaatcaatgttatctgacttaacattcaacaacattttaagaatggtggccggaaaacgttactacggagacggtgttgaggatgatccggaggctaaacgtgtccggcagcttatagcggatgtggtggcttgtgctggtgctggaaacgctgttgattacttaccggttttgcggttggtttcagattacgagacacgggttaagaagttggcgggtaggctcgacgagttcttgcaaggattggttgatgagaaacgagaagctaaggagaaaggaaacactatgatcgatcacttgcttactctgcaagaatcccaaccggattacttcacggatcgtatcattaaaggaaacatgctcgctttgatactagcagggaccgacacatcagcggttacgttagaatgggcattgtcgaacgtgttgaaccatccggatgtattgaacaaggcgagagatgaaatcgatagaaagataggtttagacaggcttatggatgaatcagatatctcaaacctgccttatctccaaaacattgtgtctgaaacgttgcgcctttatcctgcggctcccatgcttcttcctcacgttgcctcggaagattgtaaagttgcaggatacgatatgccgcgtggcacgatactattgaccaatgtgtgggctatacacagagatcctcagctatgggatgatccaatgagcttcaagccagagaggtttgagaaagaaggagaagctcagaagctaatgccgtttgggttaggaagaagggcgtgtcctggttctggactggctcatcggcttataaacctgactcttggatcattgattcagtgtttggaatgggagaagattggagaagaagtggatatgagtgaaggcaaaggtgttacaatgcctaaagccaagcctttggaagccatgtgcagagcacgtccctctgttgttaaaatcttcaacgagtccgtttgacgttga

SEQ ID NO: 925 - DNA, 845 bp, Arabidopsis thaliana
ttctctgtctctttggcttttctcctcctgttctcatggaagcttcacccaatgatcgacttcattttggcaaaatgggtttcgggtgtaagcattacaagaggagatgccaaatcagagctccatgttgcaacgaagtcttcgattgtcgccattgtcacaacgagagcactagcacattgcgcaatatctacgaccgtcacgatcttgttcgtcaagacgttaaacaagtgatttgttctgtttgcgatacagagcagccggcagctcaagtttgttcgaattgtggtgtcaacatgggagaatatttttgcagcatctgcatattctatgatgatgatactgaaaaacaacagtttcattgcgatgactgtggaatttgcagagttggtgggcgtgagaatttcttccattgcaagaagtgtggatcttgttatgcggttggtctgcgcaacaaccatcgctgcgttgagaattcaatgcgtcatcactgtcccatttgttacgagtacctttttgactctctaaaggacacaaatgtgatgaaatgcgggcacacaatgcacgtagaatgctacaacgagatgatcaaacgtgacaagttttgttgtccaatttgctcgaggtcagtgattgatatgtctaaaacatggcagagactcgatgaagagatcgaagccactgctatgccttcagattaccgtgacaagaaggtttggatactttgcaacgattgtaacgacacaacagaagtgcacttccacataatcggacagaaatgtggacattgcagatcatacaacacacgagcgattgcgcctcctgttcttcctcaatgacaatag

SEQ ID NO: 926 - protein, 1757 aa, Arabidopsis thaliana
MDSQDHKAPGFVDIVKSWIPRKSESSNMSRDFWMPDQSCPVCYECDAQFTVFNRRHHCRLCGRVFCAKCAANSIPSPSDETKDSHEEPERIRVCNYCYKQWEQGIVPPDNGASIISLHFSSSPSARSVASTTSNSSNCTIDSTAGPSPRPKMNPRASRRVSSNMDSEKSEQQNAKSRRSSDHYGHVLDSSDNQVEFFVNSSGRSDGEADDDDDYQSDFAQSYAQGNDYYGAINLDEVDHIYGSHEAHDVGVKIEPNISGFPPDQDLDSLNTETIDKTRQQENGWNDVKEGSPPCEESFEPEVVDFESDGLLWLPPEPENEEDEREAVLSDDDGDEGDRGDWGYLRPSNSFNEKDFHSKDKSSGAMKNVVEGHFRALVAQLLEVDNLPMVNEGDEEGWLDIITSLSWEAATLLKPDTSKSGGMDPGGYVKVKCIPCGRRSESMVVKGVVCKKNVAHRRMTSKIEKPRLLILGGALEYQRISNQLSSFDTLLQQEMDHLKMAVAKIDSHNPDILLVEKSVSRFAQEYLLAKDISLVLNIKRSLLERISRCTGAQIVPSIDQLTSPKLGYCDLFHVEKFVETHVSPCQVAKKMAKTLMFFDGCPKPLGCTILLKGAHEDELKKVKHVIQYGVFAAYHLALETSFLADEGASIHELPLQTPITVALPDKPSMVNRSISTIPGFTVSSAEKSPTTELRGEPHKANGDLTGNFTSSKTHFQGKLDGNDRIDPSERLLHNLDTVYCKPPETITSKDDGLVPTLESRQLSFHVEEPSVQKDQWSVLSGATEQVTDGGYTNDSAVIGNQNFNRQEQMESSKGDFHPSASDHQSILVSLSTRCVWKGSVCERAHLLRIKYYGSFDKPLGRFLRDNLFDQDQCCPSCTMPAEAHIHCYTHRQGSLTISVKKLPELLPGQREGKIWMWHRCLKCPRINGFPPATRRIVMSDAAWGLSFGKFLELSFSNHAAASRVANCGHSLHRDCLRFYGFGRMVACFRYASINIYAVTLPPAKLYFNYENQEWLQKESKEVIKKAEVLFNEVQEALSQISAKTMGAGSKGSTPNKIKLSLEELAGLLEQRKKEYKDSLQQMLNVVKDGQPTIDILLINKLRRLIIFDSYAWDECLAGAANMVRNNYLEAPKNSAPKVMGRNVSLEKLSDEKVKSIPTHVAICNDSLLQDADYETCLNQGKSFADTSGKFAIPEDVGSDRPPDCRMEFDPSEGGKDNFVESSQVVKPAHTESQFQATDLSDTLDAAWIGEQTTSENGIFRPPSRAASTNGTQIPDLRLLGSESELNFKGGPTNDEHTTQVQLPSPSFYYSLNKNYSLNSRKHIMAEDRPVYVSSYRELEWRSGARLLLPLGCNDLVLPVYDDEPTSIIAYALTSSEYKAQMSGSDKSRDRLDSGGSFSLFDSVNLLSLNSLSDLSVDMSRSLSSADEQVSQLLHSSLYLKDLHARISFTDEGPPGKVKYSVTCYYAKEFEALRMICCPSETDFIRSLGRCRKWGAQGGKSNVFFAKSLDDRFIIKQVTKTELESFIKFGPAYFKYLTESISTKSPTSLAKILGIYQVSSKHLKGGKEFKMDVLVMENLLFKRNFTRLYDLKGSTRARYNPDTSGSNTVLLDQNLVEAMPTSPIFVGSKAKRLLERAVWNDTSFLASIHVMDYSLLVGVDEERNELVLGIIDFMRQYTWDKHLETWVKTSGLLGGPKNSTPTVISPQQYKKRFRKAMTAYFLMVPDQWSPAAVVPSNSSSAEVKEEEEKDNPQAVGNKS

SEQ ID NO: 927 - protein, 304 aa, Arabidopsis thaliana
MANSKYEYVKSFEVEDEVMFPNLIIIRIDGRDFSRFSQVHKFEKPNDETSLNLMNSCASSVLVEYPDIVFAYGYSDEYSFVFKKASRFYQRRASKILSLVASFFAAVYVTKWKEFFPHTKLEYAPSFASKVVSCASVEVLQAYLAWRQHDCHISNQYDTCLWMLVKSGKTLSETQEILKDTQKQQRNELLFQQFGINYKMLPVLFRQGSCLFKTKLEETVKHDENGKPVKRLRRRETLVHSENVAGRSFWNEHSSLHKDLGHFAKDIGKIEPDYVKSFQFESRLLPLTWVVVRIDGCHFHSGCS

SEQ ID NO: 928 - protein, 306 aa, Arabidopsis thaliana
MEKDDNSDKVCLSVKEKYTSEQPEEMVTNLKASVRELSVKVKEQNQRKCDAKDKLQQLRERISKEVVDVSVQELIPLLRSLKEFVKEESEVRSRCNVKRSALEDAVHDLEERAGKGLDGEIQEEDLDGLLVVSLDNLTSAEKELGATLREIVSLKRQIDDVPCQSELLQYERRFSELNVCIQEKLQQTRKLYATYNALLEIKDLMLKETSLLNSIGSPFQDVIGTPAGRVKLIDSMEGVMKGIQQKIGKIQLGLQEEQRLRDASKEKYIAAAAEQRKCYTVLRAYQEECTKNERLRSHISAMNEHL

SEQ ID NO: 929 - protein, 804 aa, Arabidopsis thaliana
MAATLLPQCYRIYNSDACKCVSSENHQTTGKRNGNRNLEFDSGISKPARLVLRDRYKVTKQVNDPALTRALRGFADSRLMEDALQLFDEMNKADAFLWNVMIKGFTSCGLYIEAVQFYSRMVFAGVKADTFTYPFVIKSVAGISSLEEGKKIHAMVIKLGFVSDVYVCNSLISLYMKLGCAWDAEKVFEEMPERDIVSWNSMISGYLALGDGFSSLMLFKEMLKCGFKPDRFSTMSALGACSHVYSPKMGKEIHCHAVRSRIETGDVMVMTSILDMYSKYGEVSYAERIFNGMIQRNIVAWNVMIGCYARNGRVTDAFLCFQKMSEQNGLQPDVITSINLLPASAILEGRTIHGYAMRRGFLPHMVLETALIDMYGECGQLKSAEVIFDRMAEKNVISWNSIIAAYVQNGKNYSALELFQELWDSSLVPDSTTIASILPAYAESLSLSEGREIHAYIVKSRYWSNTIILNSLVHMYAMCGDLEDARKCFNHILLKDVVSWNSIIMAYAVHGFGRISVWLFSEMIASRVNPNKSTFASLLAACSISGMVDEGWEYFESMKREYGIDPGIEHYGCMLDLIGRTGNFSAAKRFLEEMPFVPTARIWGSLLNASRNHKDITIAEFAAEQIFKMEHDNTGCYVLLLNMYAEAGRWEDVNRIKLLMESKGISRTSSRSTVEAKGKSHVFTNGDRSHVATNKIYEVLDVVSRMVGEEDIYVHCVSRLRPETLVKSRSNSPRRHSVRLATCFGLISTETGRRVTVRNNTRICRKCHEFLEKASRLTRREIVVGDSKIFHHFSNGRCSCGNYW

SEQ ID NO: 930 - protein, 453 aa, Oryza sativa
MSSLTAAQFRSLFEMAGGEDISFLFGDDEAAAVAAPVELQGKRGWEEVDQGEGSGAVAAKRQRSPTSSRENSSGSNEGGQEEVSEAAAAMAAAVGRGGGRRLWVKERDSEWWDMVSSPDYPDSEFRKAFRMSKATFEVVCDELAAAVAKEDTMLRAAIPVRKRVAVCVWRLATGEPLRLVSKRFGLGISTCHKLVLEVCAALKAMVMPKVVRWPEAGDAAAIAAHFEAISGISGVVGAIYTTHIPIIAPKSNVASYYNRRHTERNQKTSYSMTVQCVVDSTGAFTDVCIGWPGSNSDEEVLEKSALYLHRGVPGLIQGQWVVGGGSFPLMDWMLVPYTHQNLTWAQHMLNEKVAAVRGVARDAFERLKRRWGCLQKRTEVKLLDLPTVLGACCVLHNICERSGDAVVDADDCAFDLFDDDMVAENAVRSSAAAQARDAIAHNLLHSGGGASFF

SEQ ID NO: 931 - protein, 114 aa, Ricinus communis
MATITVKLISFLVLCLVVAMPMTTEAITCGQVVSGLSSCLSYLRSGGAVPPACCNGVRGLNSAAKTTADRQQVCVCLKSAAAGINLSNASSLPGKCKVNIPYKISPSTDCKSIK

SEQ ID NO: 932 - protein, 174 aa, Arabidopsis thaliana
MENMLGLLRLHVIRGVNLAIRDSQSSDPYVIVRMGKQKLRTRVMKKNLNTEWNEDLTLSVTDPTLPVKIMVYDRDRFSRDDKMGDAIFHIDPFLEAIRIQNQLGGLPEGTVIMKIQASRQNCLSEESKIVWHKGKIVQNMFLKLQNVERGEIELQLEWIDVSGALTDDAEDVAF

SEQ ID NO: 933 - DNA, 1370 bp, Oryza sativa
tttagatgagctcactgacggcggcgcagttccggtcgctgtttgagatggcaggaggggaggatatctcgtttctgtttggtgatgatgaggcggcggcggtggcggcgccggtggagttgcaggggaagagggggtgggaggaggtggatcaaggggaggggtctggggcggtggcggcgaagaggcagcggtcgccgacgagctcgagggagaatagtagcgggagtaatgagggtgggcaggaggaggtgtctgaggcggcggcggccatggcggcggcggtggggaggggtggggggaggaggctgtgggtgaaggagagggactcggagtggtgggacatggtgagtagcccggattacccggactcggagttcaggaaggcgttccgcatgtccaaggccacgttcgaggtggtctgcgacgagctcgccgccgccgtcgccaaggaggacaccatgctccgcgccgccatcccggtgcgcaagcgcgtcgccgtctgcgtctggcgcctcgccacgggggagcccctgaggctggtgtccaagcgcttcggcctcgggatctccacctgccacaagctcgtgctcgaggtctgcgccgcgctcaaggccatggtgatgcccaaggtggtgcgctggcccgaggccggcgacgcggcggccatcgccgcgcacttcgaggccatctccgggatctccggcgtcgtcggcgcgatctacaccacccacatccccatcatcgcgcccaagtccaacgtcgcctcctactacaaccgccgccacacggagcgcaaccagaagacctcctactccatgaccgtccagtgcgtcgtcgactccaccggcgccttcaccgacgtctgcatcggctggccggggtccaactccgacgaggaggtgctcgagaagtcggcgctgtacctgcaccgcggcgttcccggcctgatccagggccagtgggtggtcggcggcgggagcttcccgctcatggactggatgctcgtgccctacacccaccagaacctgacgtgggcgcagcacatgctcaacgagaaggtcgccgccgtgcgcggcgtggcgcgcgacgcgttcgagcgcctcaagcgccggtggggctgcctccagaagcgcaccgaggtgaagctgctcgacctccccaccgtgctcggcgcctgctgcgtcctccacaacatctgcgagcgcagcggcgacgccgtcgtcgacgccgacgactgcgccttcgacctcttcgacgacgacatggtcgccgagaacgccgtccgctcctccgccgccgcgcaggcccgcgacgccatcgcccacaacctcctccacagcggcggcggcgcatccttcttctgatca

SEQ ID NO: 934 - DNA, 22 bp, Artificial sequence
  Single strand DNA oligonucleotide
cgcctgaagcttctccgagaac

SEQ ID NO: 935 - DNA, 33 bp, Artificial sequence
  Single strand DNA oligonucleotide
ataagcttattgattcctttaaagacttatgtt

SEQ ID NO: 936 - DNA, 32 bp, Artificial sequence
  Single strand DNA oligonucleotide
tcgtcgacgggtgtatgtttttaatcttgttt

SEQ ID NO: 937 - DNA, 23 bp, Artificial sequence
  Single strand DNA oligonucleotide
acggtgtttccagaatttcgcag

SEQ ID NO: 938 - DNA, 24 bp, Artificial sequence
  Single strand DNA oligonucleotide
ctgaatgtgactgggatatgtcgg

SEQ ID NO: 939 - DNA, 23 bp, Artificial sequence
  Single strand DNA oligonucleotide
tgcactggagcgtgtagggacag

SEQ ID NO: 940 - DNA, 25 bp, Artificial sequence
  Single strand DNA oligonucleotide
ggcagaaactgttttatggaaatgg

SEQ ID NO: 941 - DNA, 22 bp, Artificial sequence
  Single strand DNA oligonucleotide
ttctgtccctcgaccaaggttg

SEQ ID NO: 942 - DNA, 26 bp, Artificial sequence
  Single strand DNA oligonucleotide
cagtcaatcttcttagcatcgctgag

SEQ ID NO: 943 - DNA, 22 bp, Artificial sequence
  Single strand DNA oligonucleotide
ccaatgccaatacgatggtcgg

SEQ ID NO: 944 - DNA, 26 bp, Artificial sequence
  Single strand DNA oligonucleotide
gagctttggagataagattggtgcag

SEQ ID NO: 945 - DNA, 23 bp, Artificial sequence
  Single strand DNA oligonucleotide
gtatcactcgaggcaccattggg

SEQ ID NO: 946 - DNA, 24 bp, Artificial sequence
  Single strand DNA oligonucleotide
atgtgggattccgagacagtgtcc

SEQ ID NO: 947 - DNA, 23 bp, Artificial sequence
  Single strand DNA oligonucleotide
tttaccgtccccaaacgttgccg

SEQ ID NO: 948 - DNA, 30 bp, Artificial sequence
  Single strand DNA oligonucleotide
ctcatccggacgatgtcttacttcttctcc

SEQ ID NO: 949 - DNA, 24 bp, Artificial sequence
  Single strand DNA oligonucleotide
gaggtgaccgatcactggtaacgc

SEQ ID NO: 950 - DNA, 23 bp, Artificial sequence
  Single strand DNA oligonucleotide
tggctttgaaaacgtaacatgcc

SEQ ID NO: 951 - DNA, 23 bp, Artificial sequence
  Single strand DNA oligonucleotide
tattgggattttcggatcgatgg

SEQ ID NO: 952 - DNA, 29 bp, Artificial sequence
  Single strand DNA oligonucleotide
aatgtcgactacctgcctttctctcgtcc

SEQ ID NO: 953 - DNA, 30 bp, Artificial sequence
  Single strand DNA oligonucleotide
aaagtcgacactctacctgcctttctctcg

SEQ ID NO: 954 - DNA, 34 bp, Artificial sequence
  Single strand DNA oligonucleotide
attctagactatgtagccatctcaacaatcaaac

SEQ ID NO: 955 - DNA, 32 bp, Artificial sequence
  Single strand DNA oligonucleotide
attctagaggttttgataaataggtactcagg

SEQ ID NO: 956 - DNA, 29 bp, Artificial sequence
  Single strand DNA oligonucleotide
ccccgggtctcggaggtatcttattccag

SEQ ID NO: 957 - DNA, 27 bp, Artificial sequence
  Single strand DNA oligonucleotide
ccccgggatgccacacttaaggccaag

SEQ ID NO: 958 - DNA, 30 bp, Artificial sequence
  Single strand DNA oligonucleotide
tcccgggtctgggtctacttttgatttgag

SEQ ID NO: 959 - DNA, 30 bp, Artificial sequence
  Single strand DNA oligonucleotide
tcccgggtgaagcagaagtttcgatttaag

SEQ ID NO: 960 - DNA, 32 bp, Artificial sequence
  Single strand DNA oligonucleotide
aaagtcgaccgaatcgtaattgttgaagagag

SEQ ID NO: 961 - DNA, 31 bp, Artificial sequence
  Single strand DNA oligonucleotide
attgtcgactttaaggagaagagtcgcagtc

SEQ ID NO: 962 - DNA, 33 bp, Artificial sequence
  Single strand DNA oligonucleotide
attctagattagagagtggttgataacgcagag

SEQ ID NO: 963 - DNA, 34 bp, Artificial sequence
  Single strand DNA oligonucleotide
actctagactacctgtcacaattttctaaaacac

SEQ ID NO: 964 - DNA, 32 bp, Artificial sequence
  Single strand DNA oligonucleotide
tatctagattgagaatgaactcagtgtgtatc

SEQ ID NO: 965 - DNA, 33 bp, Artificial sequence
  Single strand DNA oligonucleotide
aatctagaaactaaacattgagaatgaactcag

SEQ ID NO: 966 - DNA, 34 bp, Artificial sequence
  Single strand DNA oligonucleotide
tgagctcttaagtcatttagtttggatcaacaac

SEQ ID NO: 967 - DNA, 29 bp, Artificial sequence
  Single strand DNA oligonucleotide
cgagctcagaccatgcatttaaggatcac

SEQ ID NO: 968 - DNA, 30 bp, Artificial sequence
  Single strand DNA oligonucleotide
ttagtcgaccacagtaaccatgtccgtctc

SEQ ID NO: 969 - DNA, 29 bp, Artificial sequence
  Single strand DNA oligonucleotide
tatctagagtgctgcttactcgctgtttc

SEQ ID NO: 970 - DNA, 30 bp, Artificial sequence
  Single strand DNA oligonucleotide
aaagtcgacctcaaacccaagaacctcatc

SEQ ID NO: 971 - DNA, 31 bp, Artificial sequence
  Single strand DNA oligonucleotide
attctagatgcaatagtagtagcagtgaacc

SEQ ID NO: 972 - DNA, 32 bp, Artificial sequence
  Single strand DNA oligonucleotide
tatctagattcagacaaaaacagagagaaact

SEQ ID NO: 973 - DNA, 31 bp, Artificial sequence
  Single strand DNA oligonucleotide
tgagctcctaagatcggtttaatcaataggg

SEQ ID NO: 974 - DNA, 31 bp, Artificial sequence
  Single strand DNA oligonucleotide
aaagtcgacaacagcttcggtttaagagttc

SEQ ID NO: 975 - DNA, 27 bp, Artificial sequence
  Single strand DNA oligonucleotide
tcccgggtctacattacggcatacggc

SEQ ID NO: 976 - DNA, 31 bp, Artificial sequence
  Single strand DNA oligonucleotide
ttagtcgacttaaaaatggagagtcaaaagc

SEQ ID NO: 977 - DNA, 32 bp, Artificial sequence
  Single strand DNA oligonucleotide
tgagctcctactacttcttgttgatgctgagg

SEQ ID NO: 978 - DNA, 28 bp, Artificial sequence
  Single strand DNA oligonucleotide
aatgtcgactcctcttgcggagagatgc

SEQ ID NO: 979 - DNA, 30 bp, Artificial sequence
  Single strand DNA oligonucleotide
attctagatctccttttgagagagtgcaac

SEQ ID NO: 980 - DNA, 29 bp, Artificial sequence
  Single strand DNA oligonucleotide
aatgtcgactcgtcgtcttcctcatttcg

SEQ ID NO: 981 - DNA, 34 bp, Artificial sequence
  Single strand DNA oligonucleotide
attctagactaatacgattggtaacaagaaaacg

SEQ ID NO: 982 - DNA, 31 bp, Artificial sequence
  Single strand DNA oligonucleotide
attgtcgactttcaataagaaatctgcgtcc

SEQ ID NO: 983 - DNA, 31 bp, Artificial sequence
  Single strand DNA oligonucleotide
aaagtcgacgaatctgcttttaagcttctcg

SEQ ID NO: 984 - DNA, 34 bp, Artificial sequence
  Single strand DNA oligonucleotide
attctagactaaagagagtgaaggaacaaagacc

SEQ ID NO: 985 - DNA, 35 bp, Artificial sequence
  Single strand DNA oligonucleotide
attctagactattttcttctgtcttctgtgtcttc

SEQ ID NO: 986 - DNA, 32 bp, Artificial sequence
  Single strand DNA oligonucleotide
aatctagacctcacttctctctctctctcttc

SEQ ID NO: 987 - DNA, 27 bp, Artificial sequence
  Single strand DNA oligonucleotide
ccccgggagcctaaagcctaacccaac

SEQ ID NO: 988 - DNA, 32 bp, Artificial sequence
  Single strand DNA oligonucleotide
aaagtcgactgatctacacagaatccatttcc

SEQ ID NO: 989 - DNA, 32 bp, Artificial sequence
  Single strand DNA oligonucleotide
aatctagatcattcagccattcacattttagg

SEQ ID NO: 990 - DNA, 30 bp, Artificial sequence
  Single strand DNA oligonucleotide
ttagtcgaccctaataatggcttgcagagc

SEQ ID NO: 991 - DNA, 32 bp, Artificial sequence
  Single strand DNA oligonucleotide
tatctagaaaatcttgagactaaatcaagctg

SEQ ID NO: 992 - DNA, 30 bp, Artificial sequence
  Single strand DNA oligonucleotide
aaagtcgacgcaagaaagggactaaccaag

SEQ ID NO: 993 - DNA, 34 bp, Artificial sequence
  Single strand DNA oligonucleotide
actctagactatgtcggcattaacttagaatcac

SEQ ID NO: 994 - DNA, 30 bp, Artificial sequence
  Single strand DNA oligonucleotide
aatctagacttgcttcaagattcgagtgag

SEQ ID NO: 995 - DNA, 30 bp, Artificial sequence
  Single strand DNA oligonucleotide
aatctagaattaaccaccatttctgtgaag

SEQ ID NO: 996 - DNA, 31 bp, Artificial sequence
  Single strand DNA oligonucleotide
tcccgggctaccttccttcttcttcacttcc

SEQ ID NO: 997 - DNA, 30 bp, Artificial sequence
  Single strand DNA oligonucleotide
tcccgggtcctaaaagtcagtcaccttctg

SEQ ID NO: 998 - DNA, 31 bp, Artificial sequence
  Single strand DNA oligonucleotide
aaagtcgacgaaggtgaagtgatggattctg

SEQ ID NO: 999 - DNA, 31 bp, Artificial sequence
  Single strand DNA oligonucleotide
aatgtcgactgttaccgataagaaggtgaag

SEQ ID NO: 1000 - DNA, 33 bp, Artificial sequence
  Single strand DNA oligonucleotide
attctagactaacagcttcaacgtaatttggtg

SEQ ID NO: 1001 - DNA, 30 bp, Artificial sequence
  Single strand DNA oligonucleotide
attctagatcaacgtcattttgtgcatatc

SEQ ID NO: 1002 - DNA, 30 bp, Artificial sequence
  Single strand DNA oligonucleotide
attctagattttcccgaatctattcatcac

SEQ ID NO: 1003 - DNA, 27 bp, Artificial sequence
  Single strand DNA oligonucleotide
ccccgggaacgcttcaccctttaatcc

SEQ ID NO: 1004 - DNA, 28 bp, Artificial sequence
  Single strand DNA oligonucleotide
aaagtcgacccgaggaagatgacgacac

SEQ ID NO: 1005 - DNA, 31 bp, Artificial sequence
  Single strand DNA oligonucleotide
tgagctcctagtttcaagcaagagtgattcc

SEQ ID NO: 1006 - DNA, 27 bp, Artificial sequence
  Single strand DNA oligonucleotide
tcccgggtattgagcagccgtgaaatc

SEQ ID NO: 1007 - DNA, 31 bp, Artificial sequence
  Single strand DNA oligonucleotide
tcccgggtggaccaaagaatcaaatagtaac

SEQ ID NO: 1008 - DNA, 29 bp, Artificial sequence
  Single strand DNA oligonucleotide
aatgtcgactcaggatctatgggcaagtc

SEQ ID NO: 1009 - DNA, 30 bp, Artificial sequence
  Single strand DNA oligonucleotide
aaagtcgacgcttgtgatcaggatctatgg

SEQ ID NO: 1010 - DNA, 34 bp, Artificial sequence
  Single strand DNA oligonucleotide
tgagctcctaaacagctttcttctactcttcatc

SEQ ID NO: 1011 - DNA, 30 bp, Artificial sequence
  Single strand DNA oligonucleotide
cgagctcacagaaaacaaaagaaactaggc

SEQ ID NO: 1012 - DNA, 29 bp, Artificial sequence
  Single strand DNA oligonucleotide
aaagtcgacgcgatagatctgacgaatgc

SEQ ID NO: 1013 - DNA, 32 bp, Artificial sequence
  Single strand DNA oligonucleotide
tgagctcctagatttcatactcaggaagccac

SEQ ID NO: 1014 - DNA, 31 bp, Artificial sequence
  Single strand DNA oligonucleotide
aacgtcgactctaccatcgacaacgagaaac

SEQ ID NO: 1015 - DNA, 33 bp, Artificial sequence
  Single strand DNA oligonucleotide
tgagctcctacattcacaacaaaccaccactac

SEQ ID NO: 1016 - DNA, 33 bp, Artificial sequence
  Single strand DNA oligonucleotide
aatgtcgacttattttgatcttcctcacttctg

SEQ ID NO: 1017 - DNA, 34 bp, Artificial sequence
  Single strand DNA oligonucleotide
aaagtcgacgatcaatctttgttatctctcactc

SEQ ID NO: 1018 - DNA, 34 bp, Artificial sequence
  Single strand DNA oligonucleotide
attctagactaatcacacaaaacgacaagaacag

SEQ ID NO: 1019 - DNA, 32 bp, Artificial sequence
  Single strand DNA oligonucleotide
actctagaacgatgtgataaaacattagaagc

SEQ ID NO: 1020 - DNA, 29 bp, Artificial sequence
  Single strand DNA oligonucleotide
aaagtcgaccgaagtgaaagtcgtgatgg

SEQ ID NO: 1021 - DNA, 29 bp, Artificial sequence
  Single strand DNA oligonucleotide
aaagtcgacacgcaaacgtgatcctaaac

SEQ ID NO: 1022 - DNA, 29 bp, Artificial sequence
  Single strand DNA oligonucleotide
attctagactcaaggggacgagatatcag

SEQ ID NO: 1023 - DNA, 30 bp, Artificial sequence
  Single strand DNA oligonucleotide
actctagaaggtagagagcatcaaggaagc

SEQ ID NO: 1024 - DNA, 29 bp, Artificial sequence
  Single strand DNA oligonucleotide
atagtcgacattctttcagttttccggtg

SEQ ID NO: 1025 - DNA, 31 bp, Artificial sequence
  Single strand DNA oligonucleotide
aaagtcgacgcttgaattctttcagttttcc

SEQ ID NO: 1026 - DNA, 32 bp, Artificial sequence
  Single strand DNA oligonucleotide
tcccgggctattttcaccagtaatttccacac

SEQ ID NO: 1027 - DNA, 33 bp, Artificial sequence
  Single strand DNA oligonucleotide
tcccgggttactttagccacaatctgtgttttc

SEQ ID NO: 1028 - DNA, 28 bp, Artificial sequence
  Single strand DNA oligonucleotide
aatctagaattttcatttgttcgcttcg

SEQ ID NO: 1029 - DNA, 34 bp, Artificial sequence
  Single strand DNA oligonucleotide
tcccgggctaacagtaggtaattttgacatccag

SEQ ID NO: 1030 - DNA, 25 bp, Artificial sequence
  Single strand DNA oligonucleotide
acccgggcattgcctgttggcttcg

SEQ ID NO: 1031 - DNA, 33 bp, Artificial sequence
  Single strand DNA oligonucleotide
acccgggttacaatacaattgtttaattcgagg

SEQ ID NO: 1032 - DNA, 29 bp, Artificial sequence
  Single strand DNA oligonucleotide
ttagtcgacaaaataatggcagctttggc

SEQ ID NO: 1033 - DNA, 32 bp, Artificial sequence
  Single strand DNA oligonucleotide
ttagtcgactctcgtcacatatcttcatcgac

SEQ ID NO: 1034 - DNA, 35 bp, Artificial sequence
  Single strand DNA oligonucleotide
tatctagactactagacaaatttgttgatcaattc

SEQ ID NO: 1035 - DNA, 36 bp, Artificial sequence
  Single strand DNA oligonucleotide
tatctagactaaagagagaactagacaaatttgttg

SEQ ID NO: 1036 - DNA, 29 bp, Artificial sequence
  Single strand DNA oligonucleotide
attgtcgactttacgaaatacgccgaatc

SEQ ID NO: 1037 - DNA, 29 bp, Artificial sequence
  Single strand DNA oligonucleotide
aatgtcgacttcgaaaccctaacaaaagc

SEQ ID NO: 1038 - DNA, 31 bp, Artificial sequence
  Single strand DNA oligonucleotide
actctagaatctgcatagcagttagaacaag

SEQ ID NO: 1039 - DNA, 30 bp, Artificial sequence
  Single strand DNA oligonucleotide
attctagagaaaggtcctcattcataatcc

SEQ ID NO: 1040 - DNA, 31 bp, Artificial sequence
  Single strand DNA oligonucleotide
aatctagacttcatattcaaatctcctctcc

SEQ ID NO: 1041 - DNA, 29 bp, Artificial sequence
  Single strand DNA oligonucleotide
cgagctcatcacaaacaaacctaagaggc

SEQ ID NO: 1042 - DNA, 30 bp, Artificial sequence
  Single strand DNA oligonucleotide
aagatatcagccattgttcttcatcatctc

SEQ ID NO: 1043 - DNA, 31 bp, Artificial sequence
  Single strand DNA oligonucleotide
acgatatcctaacagggttttcagtgctgtg

SEQ ID NO: 1044 - DNA, 35 bp, Artificial sequence
  Single strand DNA oligonucleotide
ttagtcgacaagacatgaagttcatgacactaatg

SEQ ID NO: 1045 - DNA, 33 bp, Artificial sequence
  Single strand DNA oligonucleotide
ttagtcgacaactgaaacaaaagaagagtcatc

SEQ ID NO: 1046 - DNA, 38 bp, Artificial sequence
  Single strand DNA oligonucleotide
tatctagattatgagctttaacaactagtataaggaac

SEQ ID NO: 1047 - DNA, 30 bp, Artificial sequence
  Single strand DNA oligonucleotide
tatctagacaccacaattttaagcttcaac

SEQ ID NO: 1048 - DNA, 31 bp, Artificial sequence
  Single strand DNA oligonucleotide
aaagtcgactgttcttgttcttcacgatgag

SEQ ID NO: 1049 - DNA, 34 bp, Artificial sequence
  Single strand DNA oligonucleotide
aaagtcgactctaaatcctatgttcttgttcttc

SEQ ID NO: 1050 - DNA, 32 bp, Artificial sequence
  Single strand DNA oligonucleotide
aattctagaggttcaaaatacgtaacacattg

SEQ ID NO: 1051 - DNA, 35 bp, Artificial sequence
  Single strand DNA oligonucleotide
aactctagaaccatattaggttcaaaatacgtaac

SEQ ID NO: 1052 - DNA, 31 bp, Artificial sequence
  Single strand DNA oligonucleotide
aaagtcgaccgatcaacagactctaatcagc

SEQ ID NO: 1053 - DNA, 34 bp, Artificial sequence
  Single strand DNA oligonucleotide
attctagattagttctatactgcagattcttggg

SEQ ID NO: 1054 - DNA, 30 bp, Artificial sequence
  Single strand DNA oligonucleotide
aatgtcgacttctctctgttcttgcactcg

SEQ ID NO: 1055 - DNA, 34 bp, Artificial sequence
  Single strand DNA oligonucleotide
aaagtcgaccttcttcttcttttctcaatctttc

SEQ ID NO: 1056 - DNA, 32 bp, Artificial sequence
  Single strand DNA oligonucleotide
attctagatctgtatcattaaaactgaggaag

SEQ ID NO: 1057 - DNA, 29 bp, Artificial sequence
  Single strand DNA oligonucleotide
attctagagtggcgagacaacatttctac

SEQ ID NO: 1058 - DNA, 33 bp, Artificial sequence
  Single strand DNA oligonucleotide
aaagtcgacctctctctctctaatgggtaattg

SEQ ID NO: 1059 - DNA, 30 bp, Artificial sequence
  Single strand DNA oligonucleotide
aatgtcgactcaccacacaacacaaccaag

SEQ ID NO: 1060 - DNA, 29 bp, Artificial sequence
  Single strand DNA oligonucleotide
actctagaaatccaacgtcaaatgagaag

SEQ ID NO: 1061 - DNA, 33 bp, Artificial sequence; identical to SEQ ID NO: 1058
  Single strand DNA oligonucleotide

SEQ ID NO: 1062 - DNA, 31 bp, Artificial sequence
  Single strand DNA oligonucleotide
aatgtcgacttggatcagagaaaatatgtcg

SEQ ID NO: 1063 - DNA, 32 bp, Artificial sequence
  Single strand DNA oligonucleotide
atagtcgaccttgaatctgaagctaatcttgg

SEQ ID NO: 1064 - DNA, 34 bp, Artificial sequence
  Single strand DNA oligonucleotide
attctagattagcattagaacgggacagtataag

SEQ ID NO: 1065 - DNA, 32 bp, Artificial sequence
  Single strand DNA oligonucleotide
actctagatcaaagaatcgagcattagaacgg

SEQ ID NO: 1066 - DNA, 30 bp, Artificial sequence
  Single strand DNA oligonucleotide
aaagtcgacctaaaccggtaaaagatgtcg

SEQ ID NO: 1067 - DNA, 30 bp, Artificial sequence
  Single strand DNA oligonucleotide
aacgtcgacacttttgttttgcctttcctc

SEQ ID NO: 1068 - DNA, 29 bp, Artificial sequence
  Single strand DNA oligonucleotide
attctagatcttcttcatcactcaatcgc

SEQ ID NO: 1069 - DNA, 32 bp, Artificial sequence
  Single strand DNA oligonucleotide
attctagactgtggtatttagggaatacatcc

SEQ ID NO: 1070 - DNA, 30 bp, Artificial sequence
  Single strand DNA oligonucleotide
aaagtcgaccacagagaaatcatggggttc

SEQ ID NO: 1071 - DNA, 30 bp, Artificial sequence
  Single strand DNA oligonucleotide
aacgtcgacagatatcgttggcttcgtctc

SEQ ID NO: 1072 - DNA, 33 bp, Artificial sequence
  Single strand DNA oligonucleotide
attctagattaggtttgatcattttaaccagag

SEQ ID NO: 1073 - DNA, 32 bp, Artificial sequence
  Single strand DNA oligonucleotide
attctagactatgcagaaatgtttggattgag

SEQ ID NO: 1074 - DNA, 29 bp, Artificial sequence
  Single strand DNA oligonucleotide
aatctagaccacaaaattcgtcaaagctc

SEQ ID NO: 1075 - DNA, 30 bp, Artificial sequence
  Single strand DNA oligonucleotide
attctagattttcaaaccacaaaattcgtc

SEQ ID NO: 1076 - DNA, 28 bp, Artificial sequence
  Single strand DNA oligonucleotide
ccccgggatccaaccaatccctaaaatg

SEQ ID NO: 1077 - DNA, 31 bp, Artificial sequence
  Single strand DNA oligonucleotide
ccccgggatcagccacttctactctcaattc

SEQ ID NO: 1078 - DNA, 31 bp, Artificial sequence
  Single strand DNA oligonucleotide
aatgtcgactccttgtgattcattattttgc

SEQ ID NO: 1079 - DNA, 31 bp, Artificial sequence
  Single strand DNA oligonucleotide
aaagtcgaccaacatctcctccaaaacattc

SEQ ID NO: 1080 - DNA, 32 bp, Artificial sequence
  Single strand DNA oligonucleotide
actctagattagcaagaagaaaagaagtgcag

SEQ ID NO: 1081 - DNA, 35 bp, Artificial sequence
  Single strand DNA oligonucleotide
attctagattagtagtttatacaaggtgcggagac

SEQ ID NO: 1082 - DNA, 30 bp, Artificial sequence
  Single strand DNA oligonucleotide
aagatatcgaaactggatctgggtttatcc

SEQ ID NO: 1083 - DNA, 34 bp, Artificial sequence
  Single strand DNA oligonucleotide
atgatatcctaaactaatcaaacatggcacatac

SEQ ID NO: 1084 - DNA, 32 bp, Artificial sequence
  Single strand DNA oligonucleotide
aaagtcgacagagttaagtcaatcaccaaacc

SEQ ID NO: 1085 - DNA, 32 bp, Artificial sequence
  Single strand DNA oligonucleotide
tcccgggttaccatcaagttttcttgctgaag

SEQ ID NO: 1086 - DNA, 34 bp, Artificial sequence
  Single strand DNA oligonucleotide
aaagtcgacccaacactatatcatggctactatc

SEQ ID NO: 1087 - DNA, 31 bp, Artificial sequence
  Single strand DNA oligonucleotide
attctagactaacctcacttgatgctcttgc

SEQ ID NO: 1088 - DNA, 30 bp, Artificial sequence
  Single strand DNA oligonucleotide
tatctagagctaaacaaaatccggagatag

SEQ ID NO: 1089 - DNA, 34 bp, Artificial sequence
  Single strand DNA oligonucleotide
tatctagacagtcactccataactatgatcaaac

SEQ ID NO: 1090 - DNA, 33 bp, Artificial sequence
  Single strand DNA oligonucleotide
ttagtcgacctcattaatggaagtttcaacatc

SEQ ID NO: 1091 - DNA, 33 bp, Artificial sequence; identical to SEQ ID NO: 1090
  Single strand DNA oligonucleotide

SEQ ID NO: 1092 - DNA, 31 bp, Artificial sequence
  Single strand DNA oligonucleotide
tcccgggtaagtttgtgagatggaattagtg

SEQ ID NO: 1093 - DNA, 30 bp, Artificial sequence
  Single strand DNA oligonucleotide
tcccgggctaattggttggttacaagatgc

SEQ ID NO: 1094 - DNA, 31 bp, Artificial sequence
  Single strand DNA oligonucleotide
aatgtcgactggactgaagatgtcaggattc

SEQ ID NO: 1095 - DNA, 31 bp, Artificial sequence
  Single strand DNA oligonucleotide
atagtcgacatttctctctattggcatcgac

SEQ ID NO: 1096 - DNA, 32 bp, Artificial sequence
  Single strand DNA oligonucleotide
aattctagactaaactggggaaagctaaaacg

SEQ ID NO: 1097 - DNA, 35 bp, Artificial sequence
  Single strand DNA oligonucleotide
aattctagatcataacataagaaagtaaactgggg

SEQ ID NO: 1098 - DNA, 31 bp, Artificial sequence
  Single strand DNA oligonucleotide
aatctagacacacccctcaaagaaatataac

SEQ ID NO: 1099 - DNA, 30 bp, Artificial sequence
  Single strand DNA oligonucleotide
aatctagaaagaaattcacacccctcaaag

SEQ ID NO: 1100 - DNA, 31 bp, Artificial sequence
  Single strand DNA oligonucleotide
tgagctcctaaaggtggagtaattagaagcg

SEQ ID NO: 1101 - DNA, 31 bp, Artificial sequence
  Single strand DNA oligonucleotide
tgagctctggtgaagtgttaagtaattgtcg

SEQ ID NO: 1102 - DNA, 33 bp, Artificial sequence
  Single strand DNA oligonucleotide
aaagtcgacgaaagagagaaaatggagaatatg

SEQ ID NO: 1103 - DNA, 33 bp, Artificial sequence
  Single strand DNA oligonucleotide
aaagtcgaccgatctaaagaaagagagaaaatg

SEQ ID NO: 1104 - DNA, 34 bp, Artificial sequence
  Single strand DNA oligonucleotide
tgagctcctaagagtcgatctagaaagcaacatc

SEQ ID NO: 1105 - DNA, 31 bp, Artificial sequence
  Single strand DNA oligonucleotide
tgagctcgaattagtccttgtggttctactc

SEQ ID NO: 1106 - DNA, 31 bp, Artificial sequence
  Single strand DNA oligonucleotide
aatgtcgactgataagaatgctcctgactgg

SEQ ID NO: 1107 - DNA, 32 bp, Artificial sequence
  Single strand DNA oligonucleotide
aatgtcgactctttctctgtatctcgacgttc

SEQ ID NO: 1108 - DNA, 30 bp, Artificial sequence
  Single strand DNA oligonucleotide
tcccgggctaaaatccaagtgcccaagaac

SEQ ID NO: 1109 - DNA, 31 bp, Artificial sequence
  Single strand DNA oligonucleotide
tcccgggctagcaaaacataaatccaagtgc

SEQ ID NO: 1110 - DNA, 31 bp, Artificial sequence
  Single strand DNA oligonucleotide
aatgtcgactcttactcaatccgaagaatgg

SEQ ID NO: 1111 - DNA, 29 bp, Artificial sequence
  Single strand DNA oligonucleotide
ccccgggacttcgattcacatttctcctc

SEQ ID NO: 1112 - DNA, 32 bp, Artificial sequence
  Single strand DNA oligonucleotide
aaagtcgaccgaagtaagaaaagaaaatggag

SEQ ID NO: 1113 - DNA, 32 bp, Artificial sequence
  Single strand DNA oligonucleotide
aaagtcgaccttcgaagtaagaaaagaaaatg

SEQ ID NO: 1114 - DNA, 32 bp, Artificial sequence
  Single strand DNA oligonucleotide
aatctagatcatactcaagtgcttgtcctcgg

SEQ ID NO: 1115 - DNA, 30 bp, Artificial sequence
  Single strand DNA oligonucleotide
attctagagttattggtgtcttgttccacc

SEQ ID NO: 1116 - DNA, 29 bp, Artificial sequence
  Single strand DNA oligonucleotide
aaagtcgaccaacgagcaagagaaaatgg

SEQ ID NO: 1117 - DNA, 32 bp, Artificial sequence
  Single strand DNA oligonucleotide
aaagtcgacgatacaacgagcaagagaaaatg

SEQ ID NO: 1118 - DNA, 32 bp, Artificial sequence
  Single strand DNA oligonucleotide
aattctagatggttctagctatcactaggtgc

SEQ ID NO: 1119 - DNA, 32 bp, Artificial sequence
  Single strand DNA oligonucleotide
aattctagaggcaatacaacaagagaaaactc

SEQ ID NO: 1120 - DNA, 29 bp, Artificial sequence
  Single strand DNA oligonucleotide
aaagtcgaccgagtacaatggaggtttcg

SEQ ID NO: 1121 - DNA, 32 bp, Artificial sequence
  Single strand DNA oligonucleotide
attctagatcaagcttaaagaccgtgaggaag

SEQ ID NO: 1122 - DNA, 27 bp, Artificial sequence
  Single strand DNA oligonucleotide
aatctagaacagtcgtcgtcgtcaagc

SEQ ID NO: 1123 - DNA, 33 bp, Artificial sequence
  Single strand DNA oligonucleotide
tcccgggctaaaggtaaggatgaattgtcagag

SEQ ID NO: 1124 - DNA, 31 bp, Artificial sequence
  Single strand DNA oligonucleotide
aatgtcgactcaaatcaatatgggatctttc

SEQ ID NO: 1125 - DNA, 30 bp, Artificial sequence
  Single strand DNA oligonucleotide
attctagattattgacaagtctattgcccg

SEQ ID NO: 1126 - DNA, 32 bp, Artificial sequence
  Single strand DNA oligonucleotide
aatgtcgacttcgttaaattatgtctttgagg

SEQ ID NO: 1127 - DNA, 31 bp, Artificial sequence
  Single strand DNA oligonucleotide
aaagtcgactgactcagagatcaacaaaacc

SEQ ID NO: 1128 - DNA, 31 bp, Artificial sequence
  Single strand DNA oligonucleotide
acccgggttagacttactccaatttccaagc

SEQ ID NO: 1129 - DNA, 26 bp, Artificial sequence
  Single strand DNA oligonucleotide
tcccgggtcaagagtcggtcacacgc

SEQ ID NO: 1130 - DNA, 28 bp, Artificial sequence
  Single strand DNA oligonucleotide
tcccgggtccttcttgtgtgagaccgag

SEQ ID NO: 1131 - DNA, 34 bp, Artificial sequence
  Single strand DNA oligonucleotide
tgagctcctaagaactttaacgcattttgtagtg

SEQ ID NO: 1132 - DNA, 31 bp, Artificial sequence
  Single strand DNA oligonucleotide
aaagtcgacaacgtgatcaatatggaagctc

SEQ ID NO: 1133 - DNA, 29 bp, Artificial sequence
  Single strand DNA oligonucleotide
aaagtcgacactcaccaaaatccaacgtg

SEQ ID NO: 1134 - DNA, 34 bp, Artificial sequence
  Single strand DNA oligonucleotide
aattctagactaaactcaagaggagtcgggtaag

SEQ ID NO: 1135 - DNA, 31 bp, Artificial sequence
  Single strand DNA oligonucleotide
aattctagattaattcgttaccgttgctaag

SEQ ID NO: 1136 - DNA, 32 bp, Artificial sequence
  Single strand DNA oligonucleotide
aaagtcgacaccaaaatagatctaaaacatgg

SEQ ID NO: 1137 - DNA, 35 bp, Artificial sequence
  Single strand DNA oligonucleotide
aatgtcgacttcactcaccaaaatagatctaaaac

SEQ ID NO: 1138 - DNA, 30 bp, Artificial sequence
  Single strand DNA oligonucleotide
aatctagatcaacgtcaaacggactcgttg

SEQ ID NO: 1139 - DNA, 33 bp, Artificial sequence
  Single strand DNA oligonucleotide
aatctagatcaccaaaagtctaaacgtcaaacg

SEQ ID NO: 1140 - DNA, 35 bp, Artificial sequence
  Single strand DNA oligonucleotide
ttagtcgaccaaagatgttttactatgtgattgtc

SEQ ID NO: 1141 - DNA, 31 bp, Artificial sequence
  Single strand DNA oligonucleotide
ttagtcgacaggaagagaaaggtcaaagatg

SEQ ID NO: 1142 - DNA, 34 bp, Artificial sequence
  Single strand DNA oligonucleotide
tatctagatcaaaatctcacatctccatgcatag

SEQ ID NO: 1143 - DNA, 33 bp, Artificial sequence
  Single strand DNA oligonucleotide
tatctagatcatgttcgcattacacaaatatcc

SEQ ID NO: 1144 - DNA, 30 bp, Artificial sequence
  Single strand DNA oligonucleotide
attctagattctctgtctctttggcttttc

SEQ ID NO: 1145 - DNA, 30 bp, Artificial sequence
  Single strand DNA oligonucleotide
attctagataaaactctcagcttcccattc

SEQ ID NO: 1146 - DNA, 31 bp, Artificial sequence
  Single strand DNA oligonucleotide
tcccgggctattgtcattgaggaagaacagg

SEQ ID NO: 1147 - DNA, 31 bp, Artificial sequence
  Single strand DNA oligonucleotide
tcccgggctaaaagttcttgcttgctttctg

SEQ ID NO: 1148 - DNA, 35 bp, Artificial sequence
  Single strand DNA oligonucleotide
aaagtcgacagattgcgtcactgtagtagtagtag

SEQ ID NO: 1149 - DNA, 32 bp, Artificial sequence
  Single strand DNA oligonucleotide
aaagtcgacctgcaactctttctcactttcac

SEQ ID NO: 1150 - DNA, 34 bp, Artificial sequence
  Single strand DNA oligonucleotide
agtctagaaaacattttgcttaagatctacagag

SEQ ID NO: 1151 - DNA, 30 bp, Artificial sequence
  Single strand DNA oligonucleotide
actctagaagacatgaaagcacaaatcaag

SEQ ID NO: 1152 - DNA, 28 bp, Artificial sequence
  Single strand DNA oligonucleotide
acccgggctaacatgctccatctccttc

SEQ ID NO: 1153 - DNA, 29 bp, Artificial sequence
  Single strand DNA oligonucleotide
tgagctctcaacctgatcagcgatggtcg

SEQ ID NO: 1154 - DNA, 31 bp, Artificial sequence
  Single strand DNA oligonucleotide
aaagtcgaccacacaagactaacgatgttgc

SEQ ID NO: 1155 - DNA, 30 bp, Artificial sequence
  Single strand DNA oligonucleotide
attctagattaaaaagagacctacacggcg

SEQ ID NO: 1156 - DNA, 31 bp, Artificial sequence
  Single strand DNA oligonucleotide
aatgtcgactctctggtctccctatatcagc

SEQ ID NO: 1157 - DNA, 33 bp, Artificial sequence
  Single strand DNA oligonucleotide
tgagctcctatttgatgttgttgttgttgtctg

SEQ ID NO: 1158 - DNA, 30 bp, Artificial sequence
  Single strand DNA oligonucleotide
atagtcgacgttttgagatatgggaggacc

SEQ ID NO: 1159 - DNA, 31 bp, Artificial sequence
  Single strand DNA oligonucleotide
aaagtcgacctctagattcttggcgattctc

SEQ ID NO: 1160 - DNA, 33 bp, Artificial sequence
  Single strand DNA oligonucleotide
attctagattagtggttttacttgagcctctcc

SEQ ID NO: 1161 - DNA, 32 bp, Artificial sequence
  Single strand DNA oligonucleotide
tgagctcctattgttcgttacggtggttttac

SEQ ID NO: 1162 - DNA, 30 bp, Artificial sequence
  Single strand DNA oligonucleotide
aatgtcgacggactttaaacatgggtgttc

SEQ ID NO: 1163 - DNA, 34 bp, Artificial sequence
  Single strand DNA oligonucleotide
attctagactactcataggtttgttacttccttg

SEQ ID NO: 1164 - DNA, 32 bp, Artificial sequence
  Single strand DNA oligonucleotide
aaagtcgacaagaagaaagaaacagagaatcg

SEQ ID NO: 1165 - DNA, 33 bp, Artificial sequence
  Single strand DNA oligonucleotide
attctagactaattgttcaaagttcagtgagcc

SEQ ID NO: 1166 - DNA, 31 bp, Artificial sequence
  Single strand DNA oligonucleotide
attctagaggagattttgtaatggattctgc

SEQ ID NO: 1167 - DNA, 31 bp, Artificial sequence
  Single strand DNA oligonucleotide
attctagagaaggagattttgtaatggattc

SEQ ID NO: 1168 - DNA, 33 bp, Artificial sequence
  Single strand DNA oligonucleotide
tcccgggttacgcttagaccatacaacgagtag

SEQ ID NO: 1169 - DNA, 30 bp, Artificial sequence
  Single strand DNA oligonucleotide
tcccggggttatttacttatggcctgtttc

SEQ ID NO: 1170 - DNA, 30 bp, Artificial sequence
  Single strand DNA oligonucleotide
aaagtcgaccaggggtttaaggattttctc

SEQ ID NO: 1171 - DNA, 29 bp, Artificial sequence
  Single strand DNA oligonucleotide
cgagctcaaatggctttctctaccctttg

SEQ ID NO: 1172 - DNA, 31 bp, Artificial sequence
  Single strand DNA oligonucleotide
aatgtcgactggtaggctgagagaaagaaag

SEQ ID NO: 1173 - DNA, 35 bp, Artificial sequence
  Single strand DNA oligonucleotide
agtctagattagagaataaaagaagaatgagaagc

SEQ ID NO: 1174 - DNA, 32 bp, Artificial sequence
  Single strand DNA oligonucleotide
aatgtcgacttaatcgttagaagatgagccag

SEQ ID NO: 1175 - DNA, 32 bp, Artificial sequence
  Single strand DNA oligonucleotide
attctagatcaggcttagaagcaaatgtccag

SEQ ID NO: 1176 - DNA, 27 bp, Artificial sequence
  Single strand DNA oligonucleotide
aatgtcgacgaggagatggcgagcaac

SEQ ID NO: 1177 - DNA, 33 bp, Artificial sequence
  Single strand DNA oligonucleotide
tatctagattattaggtattgcacttccacttc

SEQ ID NO: 1178 - DNA, 31 bp, Artificial sequence
  Single strand DNA oligonucleotide
aaagtcgaccaccagaaacaaagagagagtg

SEQ ID NO: 1179 - DNA, 31 bp, Artificial sequence
  Single strand DNA oligonucleotide
attctagatatcatgcaaccacaaacaatag

SEQ ID NO: 1180 - DNA, 29 bp, Artificial sequence
  Single strand DNA oligonucleotide
aatctagaaagtccaagtgaccaaccatc

SEQ ID NO: 1181 - DNA, 28 bp, Artificial sequence
  Single strand DNA oligonucleotide
tcccggggggatacaagattatgcaggc

SEQ ID NO: 1182 - DNA, 277 bp, Artificial sequence
  NOS terminator
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 1183 - DNA, 2322 bp, Artificial sequence
  Arabidopsis derived At6669 promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 1184 - DNA, 877 bp, Artificial sequence
  Cauliflower mosaic virus 35S promotor
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 1185 - DNA, 1754 bp, Arabidopsis thaliana
caaatatgagtttatgctctgatctcactgagaaattagacgaggagattttagaggacttgacgtccaatgtgaagcaaatacaagacaacgtattggaggagatactcacacttaatgctaacacagagtatcttcgacgttttctccatgggagctctagtaaagagcttttcaagaagaacgtccctgtggtgacctacgaggatgtgaagccttttatcgatcgtgtcacgaatggagagccctctgatattatctctggcaaccccattaccggattccttctaagttctggaacatccggaggaaaacagaagatgtttcctcgtaacaacaagtacttggaaaacataaaattcatcttttattaccgatcgctcgttataagcaagcatatagatggtcttgaacatggaaagggaatggtatttaacttttgtacatcagagaacacaactccttctggtttgccatcatcagctgcatcgacgagcttcttcaagagtgattatttcaagaaccgaccatcgtattggcattggtcttacacaagccctgacgaagtcatattgtgttcagacaccaagcagactttgtactgtcatcttctatgcggtcttgttcaaagagacgatgttgtgaaggttggtgccgcctttgttactattttggtccgagcaataaatcttcttgagaattcttggaaggaaatttgcactaatatccgttttggtcatcttagtgagtggatcactgatattagttgtagagactccgtttcaaagattcttggagagcctaatcctgaattggctgatctcatagaaaatgaatgcaacaataaatcatgggaaggtatagttccaagactttggcctaaagccaaattcatagaatgcattgcaaccggtcaaatggctcaacacatcccaacattggagttttactctaacaagttgccatcgatttcctcgagttacgtatcttctgaaactatgtttggtattaatatgagtcctctttgcaaaccagaaaatgtatcatacacatttctgcccaacttgtcatattttgagttcctacttgttgatgccggtgacaaaaccgaaattgttgatctcgtggatgtcaagttagggtgctattacgagcccttggtcacaaatcattccggcctacacagatataagatgggtgatattttactggtgactggattttataataatgcacctcaatttagatttgtgcgtagaggaaatctgactctaagtattcatttggagataactacagatgaagaccttttaaacgcggtcacagacgcaaagatggttcttgaatcatcaaatttgatgttgatggacttcacaagctatgcggatatttctactactccgggtcattatgttctttattgggagctcaaagcaaaataccgcaacgacattgttgaaatcgataagaatgttttggtagaatgttgctatgtggtggaagaatcattgaacaattcttatagagtatataggagtaaaggtggattaattggagctttggagataagattggtgcagcaaggaacttttgatgctctcatggagtttttcatcactcaaggtgcttcttcaactcaatacaagacacctatttgcatcaaatctactgaggccttggtgattttagaagaaaatgtccatgcttgtttctttactgataagtccctttctttgaacttttcgtcataataa

What is claimed is:

1. A method of increasing a trait of a plant under non-stress growth conditions as compared to a non-transformed plant which is grown under the same growth conditions, the trait is selected from the group consisting of: rosette diameter, growth rate of plot coverage, growth rate of rosette diameter, growth rate of rosette area, and growth rate of leaf blade area, the method comprising:
   (a) expressing within the plant an exogenous polynucleotide comprising a nucleic acid sequence encoding the polypeptide set forth in SEQ ID NO: 132, and
   (b) selecting plants resulting from step (a) for an increased rosette diameter, growth rate of plot coverage, growth rate of rosette diameter, growth rate of rosette area, and/or growth rate of leaf blade area under non-stress growth conditions as compared to a non-transformed plant which is grown under the same growth conditions,
   thereby increasing the trait of the plant under the non-stress growth conditions.

2. The method of claim 1, wherein said nucleic acid sequence is set forth in SEQ ID NO: 27 or 868.

3. A method of selecting a plant having increased rosette diameter, growth rate of plot coverage, growth rate of rosette diameter, growth rate of rosette area, and/or growth rate of leaf blade area under non-stress growth conditions as compared to a non-transformed plant which is grown under the same growth conditions, the method comprising:
   (a) providing plants transformed with an exogenous polynucleotide encoding the polypeptide set forth in SEQ ID NO: 132,
   (b) selecting said plants for increased rosette diameter, growth rate of plot coverage, growth rate of rosette diameter, growth rate of rosette area, and/or growth rate of leaf blade area under non-stress growth conditions as compared to a non-transformed plant which is grown under the same growth condition, and
   (c) growing a crop of said plant transformed with said exogenous Polynucleotide,
   thereby selecting the plant having increased rosette diameter, growth rate of plot coverage, growth rate of rosette diameter, growth rate of rosette area, and/or growth rate of leaf blade area under the non-stress growth conditions as compared to the non-transformed plant which is grown under the same growth conditions.

4. The method of claim 3, wherein said growing comprises seeding seeds and/or planting plantlets of said plant transformed with said exogenous polynucleotide.

5. The method of claim 1, wherein said trait is rosette diameter.

6. The method of claim 1, wherein said trait is growth rate of rosette diameter.

7. The method of claim 1, wherein said trait is growth rate of plot coverage.

8. A method of generating a transgenic plant, comprising:
   (a) expressing within the plant an exogenous polynucleotide comprising a nucleic acid sequence encoding the polypeptide set forth in SEQ ID NO: 132, and
   (b) selecting plants resulting from step (a) for an increased trait selected from the group consisting of: rosette diameter, growth rate of plot coverage, growth rate of rosette diameter, growth rate of rosette area, and growth rate of leaf blade area under non-stress growth conditions as compared to a non-transformed plant which is grown under the same growth conditions,
   thereby generating the transgenic plant.

9. The method of claim 8, wherein said nucleic acid sequence is set forth in SEQ ID NO: 27 or 868.

10. A method of producing a crop comprising:
    (a) selecting a parent plant transformed with an exogenous polynucleotide encoding the polypeptide set forth in SEQ ID NO: 132 for an increased trait selected from the group consisting of: rosette diameter, growth rate of plot coverage, growth rate of rosette diameter, growth rate of rosette area, and growth rate of leaf blade under non-stress growth conditions as compared to a non-transformed plant which is grown under the same growth conditions;
    (b) collecting seeds of the parent plant selected in (a); and
    (c) growing a progeny crop plant of said parent plant, wherein said progeny crop plant comprises said exogenous polynucleotide and has said increased rosette diameter, said increased growth rate of plot coverage, said increased growth rate of rosette diameter, said increased growth rate of rosette area, or said increased growth rate of leaf blade,
    thereby producing the crop.

11. The method of claim 10, wherein said nucleic acid sequence is set forth in SEQ ID NO: 27 or 868.

12. A method of producing seeds of a crop comprising:
    (a) selecting a parent plant transformed with an exogenous polynucleotide encoding the polypeptide set forth in SEQ ID NO: 132 for an increased trait selected from the group consisting of: rosette diameter, growth rate of plot coverage, growth rate of rosette diameter, growth rate of rosette area, and growth rate of leaf blade under non-stress growth conditions as compared to a non-transformed plant which is grown under the same growth conditions,
    (b) collecting seeds of the parent plant selected in (a);
    (c) growing a seed producing crop plant from the seeds resultant of step (b), wherein said seed producing crop plant comprises said exogenous polynucleotide and has said increased rosette diameter, said increased growth rate of plot coverage, said increased growth rate of rosette diameter, said increased growth rate of rosette area, or said increased growth rate of leaf blade, and
    (d) producing seeds from said seed producing crop plant resultant of step (c), thereby producing seeds of the crop, wherein said seeds produced from the seed producing crop plant comprise said exogenous polynucleotide.

13. The method of claim 12, wherein said nucleic acid sequence is set forth in SEQ ID NO: 27 or 868.

* * * * *